United States Patent 9,254,311 (MODIFIED POLYNUCLEOTIDES FOR THE PRODUCTION OF PROTEINS) - sequence listing, part 6

SEQ ID NO: 5991 - DNA, 8978 bp, Homo sapiens
cgtaggggctggctagccgccatcttgcttctttttctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccagattctctcccagcctaacctggtccctccattggtaagagccccacatactaacaccttcccagcgcctgttcagaggccaccaatggcactggccagtcagatgcctcctccgctgaccacaggcctcatgagccatgctcgtttgccacatgtagccaggggtccttgtggatcactatctggagtcagaggtaatcaggcccaggctgcgttgaaggctgaacaagacatgaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaa

SEQ ID NO: 5992 - DNA, 7962 bp, Homo sapiens
gtacccaatcagatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagcagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccagattctctcccagcctaacctggtccctccattggtaagagccccacatactaacaccttcccagcgcctgttcagaggccaccaatggcactggccagtcagatgcctcctccgctgaccacaggcctcatgagccatgctcgtttgccacatgtagccaggggtccttgtggatcactatctggagtcagaggtaatcaggcccaggctgcgttgaaggctgaacaagacatgaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaa

SEQ ID NO: 5993 - DNA, 2980 bp, Homo sapiens
aaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggtaaactatggcatggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccct

SEQ ID NO: 5994 - DNA, 8540 bp, Homo sapiens
cgtaggggctggctagccgccatcttgcttctttttctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaa

SEQ ID NO: 5995 - DNA, 8834 bp, Homo sapiens
cgtaggggctggctagccgccatcttgcttctttttctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagcagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaaccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccagattctctcccagcctaacctggtccctccattggtaagagccccacatactaacaccttcccagcgcctgttcagaggccaccaatggcactggccagtcagatgcctcctccgctgaccacaggcctcatgagccatgctcgtttgccacatgtagccaggggtccttgtggatcactatctggagtcagaggtaatcaggcccaggctgcgttgaaggctgaacaagacatgaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaa

SEQ ID NO: 5996 - DNA, 2289 bp, Homo sapiens
atactaccaccaactcagatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagcagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaa

SEQ ID NO: 5997 - DNA, 1091 bp, Homo sapiens
agcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcgtccgggaaagccagaaggaccacccccacaaggaggaaaccagtcccaaggtcccccgcctcatccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggaccaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaataagaagatgacagtgattcaaatgattcaaatgccatgacattggaagaaggtggtcatagctctacctttaatataccaataaaataaacagctta

SEQ ID NO: 5998 - DNA, 1058 bp, Homo sapiens
agcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcatccgggaaagccagaaggaccacccccacaaggaggaaaccagtcccaaggtcccccacctcgtccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggaccaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaataagaagatgacagtgattcaaatgattcaaatgccatgacattggaagaaggtggtcatagctc

SEQ ID NO: 5999 - DNA, 673 bp, Homo sapiens
agcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggaagtgaataagaagatgacagtgtttcaaatgccttgaaacataatgtgatcatgctctaacttcaatataccaataaaataatcagcttgcaatttctgattatagcatctcct

SEQ ID NO: 6000 - DNA, 673 bp, Homo sapiens; identical to SEQ ID NO: 5999

SEQ ID NO: 6001 - DNA, 641 bp, Homo sapiens
agcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggtatgattccagtttattatccatcaaaggctccaactgctacagttctccaacttcattgtgccagtgaatctattgaaaagc

SEQ ID NO: 6002 - DNA, 641 bp, Homo sapiens; identical to SEQ ID NO: 6001

SEQ ID NO: 6003 - DNA, 1781 bp, Homo sapiens
aggacaataatgttttattgagcgcctattgtgaatcagacactgagcagtaagcgtcggagaaacaggtgaatgataccggggaaaagtcattccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacgctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatactttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaataaatgcattgcctat

SEQ ID NO: 6004 - DNA, 1446 bp, Homo sapiens
ggcagcacgcccggaccttgtggtacgacaggcccagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatactttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaataaatgcattgcctatagactttgctcttgaa

SEQ ID NO: 6005 - DNA, 1983 bp, Homo sapiens
aatacctcactcagcacaccgtctgtcacccaaacaagcatccaatgaggaaaatgaacacactgctccttgtgagcttatcttttctctacctcaaagaggttatgggtctgaagtgtaatacctgcatatacacagaaggatggaagtgtatggcaggccgaggcacttgcattgcaaaagaaaatgagttatgttcaacaacagcctatttcaggggagacaaacatatgtactcaacacatatgtgtaagtataagtgccgggaagaggagtcctccaaaagaggcctgttgagagtgacactgtgctgtgacagaaacttctgtaatgtcttctaatggagcttaggaacttgcagaggatcatctgatcaagatccagaatcaagaccaaccaacatgaactgttttatttcccacaccaaattccacactggcctaagatcccagagagagctgcaggggctgtcctcattgcaatgaaggggctccccacaccccacctccaccactagattcctaaaatcatgagcattgaaacaaaatcctccatgagctatgcttattcttttgtcttctactcctgatttctgatttctatcccttgtaggctaaataatggacccccaaatatttctacatcctaatctctggaacctgtgaatgttaccttacatggcaaaagggactttgaaaatgtgattaaggatcttgagaaggggaggttatcttgcattatctgggggggccctaagtggaatcaaaatgcaaaatgcaataagatgcaagtaaagggagatatgacaaagaagaggaaaagatgatgtgataatggaagcagagattggagccatgtgctttgaagatggaggaataggccataagctaaaactaggaggccactagaagctgaaaaagtcaaggaaataggttctcccctcagagcctccagaaaccagccctgctgacaccttgatttaagccctgtaagactcattttggatgtctggcctccagaactctaagcgggtgtggttttcagccacaaagtgtgtattgttttaagccactaagtttgcaataatttattatagcagcaatgggaaactaatacaatccaaataaacttctaggaattcaaatcattggtaagcctgagtacccaggggccagtctaggtgacaacagtatccaccgctcagggcttacagtgacctgcaggaagagaggaataacagagcacatgctatgaataaatgtggagatcaatttgtggattttaaacttcatgacatgctgcagataatcctttaggtgtatctgtggtaaatggtgccttgctatgttctgaagcaatcaaacatgatgtcctaatagctcaatttatcagttcctcattagcttgtgtactcactgaaattcttttagcagttaatgtccttgtattagtctgttttcatgctgctgataaggacatacccacgactgggcaatttacgaaagaaaggggtttatcggacttacagttccacgtggctggggaagcctcacaatcatggcagaaggtaaaaggcatgtctcacatagtgacagacaagagaagagagattgtgcaggaaaactctcccttataataaccatcagatcttgtgagacttactcactatcacgagaatagcacaggaaaaacctgcccccatgattcaattacctcccaccggtccctcccacaacacgtgggaattgaagatgaaatttgggtggggacacagccaaaccatatcagtccccttcttaaaactctcctctctagctcctatgactgtacatttgtagttctcccacctctctgaagaatcctctgtgagggtctctggggactttgttttgatttgttattgtttttatattcagtctttaacctatgtgaagccacctttgtaatactgccttaagtaaagatccagtattatttttctcc

SEQ ID NO: 6006 - DNA, 1020 bp, Homo sapiens
atttgaggccatataaagtcacctgaggccctctccaccacagcccaccagtgaccacgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgctgccatccttgcgctgctccctgcactcggcctgctgctctggggacccggccagctctaggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcc

SEQ ID NO: 6007 - DNA, 309 bp, Homo sapiens
atgggttcccgctgtgccaagctcaacacaggccagagcccaggccacagcccaggccacagcacgggccatggccggggccacgaatcctccatgaaaaagctcatggcctgtgtgagtcaggataacttctccttgtcatcagcgggcgaggaagaggaggaagaggaggaggagggggaagaggaggagaaagaagagctgccggtgcagggcaagctgctgctgctggagcctgagcggcaggaggagggccacaaggacaacgccgaggcccagcagagccccgagcccaagcggacaccctcc

SEQ ID NO: 6008 - DNA, 812 bp, Homo sapiens
aggcacactctaccaccatgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctca

SEQ ID NO: 6009 - DNA, 982 bp, Homo sapiens
atccgttagaaggagcattgaggagtagatacccacttgccatggcctgtgggccgggggatcttcaaagccttacatctccgctttcctctgccagattagattatcagccgtctattgaagggccctggctccgggcctgcggtcagaccaacgtgtcctgcagggtggtgaaggggaagctggtagaggtaggcaagtggccatggcaggtgagcatccttttcctgggcacgtacatctgcagtggctccctcatccaccaccagtgggtcctcacggctgcgcactgcttgcagagattcaaggacctcagcctgtactccgtgatggtgggagtccaccagcgcccagaaaatagcactcagctcccgctcactcgcatggtgattcataaggatttcagcaatctcatgtctcaggacattgccctcctaaagctcagggactccatctcgtggtcccccttcgtccagcctgtctgcctccctaacatcaaattcaagccatccattggaagcatgtgctgggtaatcggctggggaactacagggaaaaaaggttgactctggaagctcccttgtctgccaaatggacaagacctggattcagataggagtggtaagctggagctttagttgtggccagcgccacttcccaggtatctacaccagcactgcccacttcaaccagtggatcaggactgaggttgctaacataaggttcatcagtagggctggccctgccttcctgagcccagttttcctcactggctacattctactgggctccttgagctccctgtggctcctgtgagcggtgtttcaaggacagtccctcccagaggctgcttctccctcccctctgttctaccctcagaagtggagacgagaggttgcccaggatggcagggcagagtgagggggagggtccgagagccactgttactttctgttgttcaatgaagatgcttttgaacttt

SEQ ID NO: 6010 - DNA, 913 bp, Homo sapiens
aaggctggcaaaaaggagaccagacaggaggcgtctgtagagatatcatgaacttcaacttagctttgttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctca

SEQ ID NO: 6011 - DNA, 3220 bp, Homo sapiens
agaacccatggccggcgtggaaaccgctgcgaggcggcgccacgacggaggctgaggtcgccggcagtatccatggcgtcccagagcggcagctccctggggctcctggcctggttcttgcttcttcagccatggctcgaagaggcccgggcaggcagggtgggtgcgcagggaggcgtagcactgctcttcccctccgcgctcccctcagggccaggcggccaggaccccggagcgagcggatgggagccgccacctgtaggggctccaggatccccagcggccccccagtccagggggaacgcagtgcgccccgcttcggtgttacttccctcagcctgtggccagcggacttcaaggataactggaggattgccggctccagacaggaagtggccctggcaggtgagcctgcagaccagcaacagacacatctgcggaggctcccttatcgccagacactgggtactcactgccgctcactgcatctctgggtgagggtttggggctcagagcttgggccctgatcaggctgtgggacctggagccagtctgtccccctccctgaacttcctcttcctcatctgtaaaagggggtgacagccccatagtttttatccagtctgggtgagacctgaggatttgcatttctaacaagtttctgggtgttgcctccgccgctgatctggggactactggctaaagtggtcaggggtcctggagggatgtggcttggagagagggaggtagctgctggctggcataggaagatggtaccaggcgggaagcacctcgaaggtgtggaagcagagtgtagaccctggaggatcttcctgcagccatctggaatacacagtgaagctgggagacacaaatgtgcatcatcgctccaaaacagcacttgtggtcccagttcgtgacgtcgttatccaccgatattttacgtctcctggaataattgaaaatgacattgcccttgccctgcttgacttccctgtgaattactccacgcacatccagcttgtgtgcctccctgaacaggctttcatggtgcaagctggtacgaactgctgggtgaccggatggggcaaagtaaatgaaacaggtgagccataccgacccgaggaggattccagaatgaccccggcaagcccagaagcccggacgtctcctgtgcacccgaaattccccaaaattccagaaacttctgtagctccagggtctccagcgaccgcagggcctccaggatcctgggttacttcagcatctacagtgggagaagccttggaatccgacggaatctctgaccttggaaggcagttttctcagggtattgtttctggtgctagatctgtcctggcctgcggggtaggtcaaaggggacacagcctggctcagggaggttgagggtcagaccctgacctagatgatttgagagagaggatagataacccgcctccgccctgggcagcctggtggggtggtgggaaggtagtggcttcacttccagtcccctctctttactgagcccaccagcctgtggccaccgtgtttcaaggatgattggaggattgccagccccaaacaagaagtggccctggcaggtgagcctgcagaccagcaacatacaccactgcggaggctccctcatcgacaggcgctgggtgctcactgccgcccactgtgtctttagtaatttggaatacaaggtgaagctgggagaccctgacttgcatgctggttccaaagaggcactggtgatcccagtttgagacatcatttttcctagcaattttgattttgccactttgacaagcgacattgcccttgctctgctcgcctactctgtgaattattcctcacatatccagcctgcgtgcctccccgaaaagctttttgaagtggaagctgggacagagtgctgggtgactggatggggccaagtgtcagagagtgtttcaggaccaatgccacttgttcttcaggagactgagctaaacattatgcgtcatgagaaatgttgtgagatgctcaagaacaagaatatatccaagagtaaaatggtcacgagggggaccgtctgtggctataatgaccaagggaaggatgcctgtcaggttataaagaggacacaaccaatccagtttgtggtgagccctggtggtcggaggatttggaaatgacccgccattggccctgggaggtgagcctccggatggaaaatgagcacgtgtgtggaggggccctcattgaccccagctgggtggtgactgcggcccactgcatccaaggcaccaaagagtactcagtggtgcttggcacctccaagctgcagcccatgaacttcagcagggccctctgggtccctgtgagggacatcattatgcaccccaagtactggggccgggccttcatcatgggtgacgttgcccttgtccaccttcaaacacctgtcaccttcagtgagtacgtgcagcccatctgcctcccggagcccaatttcaacctgaaggttgggacgcagtgttgggtgactggctggagccaggttaagcagcgcttttcagccaactccatgctgaccccagagctgcaggaggctgaggtgtttatcatggacaacaagaggtgtgaccggcattacaagaagtccttcttccccccagttgtcccccttgtcctgggggacatgatctgtgccaccaattatggggaaaacttgtgctatggggattctggagggccattggcttgtgaagttgagggcagatggattctggctggggtgttgtcctgggaaaaggcctgcgtgaaggcacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctgacctccctaccttttcctcctcctgccttgcctctgctgaatggggccagatggtttgaccaaggtcatgtgtccatcttcaaaaagagtcagggtggggaagagtaacccctgggagaatgggtctggctttggcatcccggtgaggagaagtgtggtggatgactaggccttgggtgagcaggagaagggaagtgtggcctagaaggattctggaatctgggaccaggagagcagggattaaacatgtgcaaacttg

SEQ ID NO: 6012 - DNA, 687 bp, Homo sapiens
atgacccgccattggccctgggaggtgagcctccggatggaaaatgagcacgtgtgtggaggggccctcattgaccccagctgggtggtgactgcggcccactgcatccaaggcaccaaagagtactcagtggtgcttggcacctccaagctgcagcccatgaacttcagcagggccctctgggtccctgtgagggacatcattatgcaccccaagtactggggccgggccttcatcatgggtgacgttgcccttgtccaccttcaaacacctgtcaccttcagctccacagccaactccatgctgaccccagagctgcaggaggctgaggtgtttatcatggacaacaagaggtgtgaccggcattacaagaagtccttcttccccccagttgtcccccttgtcctgggggacatgatctgtgccaccaattatggggaaaacttgtgctatggggattctggagggccattggcttgtgaagttgagggcagatggattctggctggggtgttgtcctgggaaaaggcctgcgtgaaggcacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctga

SEQ ID NO: 6013 - DNA, 1604 bp, Homo sapiens
gactcacttccgggaaggggcggaagaggtgggctggtggaggcggggtcgagatggcggcgcctttgaggattcagagcgactgggcgcaagccctcaggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctg

SEQ ID NO: 6014 - DNA, 1491 bp, Homo sapiens
atgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttgg

SEQ ID NO: 6015 - DNA, 975 bp, Homo sapiens
gggaaggggcggaagaggtgggctggtggaggcggggtcgagatggcggcgcctttgaggattcagagcgactgggcgcaagccctcaggaaggatgaaggggaggcctggctgagctgtcatcccccagctgattgttaaaaagatcctggcatctcccttctctctcttacttcctctctcaccatgtgatctctgcatacactggctccccttctccttctgccatgagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctg

SEQ ID NO: 6016 - DNA, 1639 bp, Homo sapiens
gtgggctggtggaggcggggtcgagatggcggcgcctttgaggattcagagcgactgggcgcaagccctcaggaaggatgaaggggaggcctggctgagctgtcatcccccagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggagg

SEQ ID NO: 6017 - DNA, 882 bp, Homo sapiens
aagaggtgggctggtggaggcggggtcgagatggcggcgcctttgaggattcagagcgactgggcgcaagccctcaggaaggatgaaggggaggcctggctgagctgtcatcccccagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcag

SEQ ID NO: 6018 - DNA, 1612 bp, Homo sapiens
gcgcctttgaggattcagagcgactgggcgcaagccctcaggatgaaggggaggcctggctgagctgtcatcccccagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaatatgaagaa

SEQ ID NO: 6019 - DNA, 2108 bp, Homo sapiens
agaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccgaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtg

SEQ ID NO: 6020 - DNA, 886 bp, Homo sapiens
gtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttggcccaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtg

SEQ ID NO: 6021 - DNA, 1598 bp, Homo sapiens
agctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaagggttggtaagattaaaagaagtccctgtattgaggcacttagcgaagtctaaattgtaaaaaagatggcgctggtatctagctccacaaaagggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaat

SEQ ID NO: 6022 - DNA, 1007 bp, Homo sapiens
cccagcactttgggaggccgaggaaggcagatcacctgaggtcaggagttcaagaccagcctgaccgacatggtgaaaccccatctctactaaaaatttaaaaagttagccgggcctggtggcgcacgcctgtaatcccagctacacaggaggctgaggcaggagaattgcttgaaccagggaggcggaggctgcagtgagccgagatcgcgccactgcactccagcctgggtgacacagcaagactccgtctcaaacaaaacaaaacaaaaaaccttccagcttggagaaactgagagtgagcagtagggagtgagggggtccctgggaggaaccagaactcatcccgcttcagggtggggctggcccccttcttggccttggccggggcttcgtgtcacggagcgcccgagggacggtcggagcccaccccagcccgcccgccgcctgagcctggccgagctctctgcacctgcacacgtctgtaaaacgcggatgaaacgcttctacggaaccgggtggctgagatgaactgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccc

SEQ ID NO: 6023 - DNA, 1391 bp, Homo sapiens
cgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttggtagagatgggggtctcgctatgttggccaggctggtctcgaattcctggcctcaacgatcgtcctgtctcggcctcccaaagtgccgggatgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaata

SEQ ID NO: 6024 - DNA, 774 bp, Homo sapiens
cgcacgcagagccacttccgggcgcggcgccggcttgctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaa

SEQ ID NO: 6025 - DNA, 629 bp, Homo sapiens
atcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctagggctcggagggaagactggcctggcctgtgagtgtggcgtagagtggggattaagcaaaggtcatgaggctgaatgctccactcttcccacaccccaacacacttcctgtgggccagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttca

SEQ ID NO: 6026 - DNA, 838 bp, Homo sapiens
acccccgcccttccggggccgaaagcgaaagcgcgctcggtctctcggtgctcgctccatcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtgacgtgcatcctcaattagaattaaagtgatgtataaatatg

SEQ ID NO: 6027 - DNA, 4603 bp, Homo sapiens
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctaggtatgtacccacagctggcgctgcatggccagccaggtggggcccactctttaatggaaccatgaagcaagtcccttcggaagtaaagcatctttatgctaagaaccatcacctcattgctgctgggaagcacagacctttgcacgttgggtcttatttaaggggcacattccatgctcgcctgtcatcaccaccgtcccagggctggcctgttcccaaaggactcccacctcgtccttgggtgtgtccttgagtccatgagctgatttagttgccttccgtaagtgcatcaccacctcctgggaggagagcatgagaagtgcccacagcccctgtgggtggtggctcaaggtagcctcccgggccttaggaggagtcagtgcagctggtggagcaggtgtcacctctgtgcaggaaggactgtcctcactcagtgtgataccgttcagggctcggagggaagactggcctggcctgtgagtgtggcgtagagtggggattaagcaaaggtcatgaggctgaatgctccactcttcccacaccccaacacacttcctgtgggccaggtaaggcttccatgtgctctgcgacccccagccccagtgcctgtggccagtgtgcacaggatgcctgtctcctgcccaggcctggcgttctccagtaggcccagctgcttctgctctggagtcttctctgtgtctcaggcacaggacctggtacctgacaagcaggaacctctgtgtcagtcacactgaggcaaatgcacacgaatagcatggcacctggcccagggggaaggcagggcagggtggagtgtcaccagcaggcccatgacagtatgtggataggacagaggtcagggagggcacaggtcagcatttcaggaactcgcagtattctttttccctcccttggaggtggggacctgacttgtaagttaatttggtaatttttaactaggaagtaaatttaaaatttacagaaaagttgcaaagaagatagaattcctgcttagcttttgccccaatttcccacttgccacccttccctctttgtgtttgtatctttttttttctgagccacatgaaagtaaagctgccttttgtgtctgtgtcactctgtgtgtgtgactgtgtaaggggtagcacacttacatggaacaggttactgcgtgtgggagaaggctcaggaaggtattcatatttatacagacggaaagctgggtggggttgcggacacactcccatagagaaggtggtgtgagcttgtctggcaggccgtgaataactttcatatcaataaggtaaattagtctccagaatatttgcgagatggaggcctagtatctatatgcaaaaaagaggggttctcagtatctcgactgtctcaacaagtcacgggtgtgccgtggcttccggcgtctcttaagggaatggtgctgcagagctcggaccaagaaggttttccagcaaagtcccatgctttgccagttgccttgagcctgggtctgggccctcaagttgaaaatgcactataatgaaaagggagaggtgtcctgaatcagtatcttatatgagagatgaaagcaggtagggaaagagaaggcctggggggttctcagtagctctggaagcatcgcaggagttggtgtggccaaggggacccaacctcctatggccctggaggggcacagcttgggtctgaggggctcagtgcctccagacacagcgttgttcctcagaaatcctgtctctgcagttagaacagttggaataccaggggggcccccttagggtaaagggggatgttcctgcccctgggatatagggcagggtgtgacttacaggctcctcctaggcagccttggtgagccccagcttcctaccacactgcctgcctttagatcaccctctacatgagtggtcccagcctgcctaacacagctaggaaaggatgaggttggtccctaatggtgggggaagcctaagaggcttcctcactccccgcagggctgagcagataactgggcacaactctccgcctcgggggcacactgcacccagcacactggtgggaggctctgtgctaagtactgtaagctgttctttaaacaccagctcttggaataaccgaacagctgcctttgtccggacacattcctttttttttttttttaataaaaaaacagctttaccgagacgtaaacacatgtcatacaattcagcagctgtcctcaggcagaggctgtgcttgccgccgccttgctttttcataggtgtgttggctgctttgtaaggacagtcagtgagttaatacccaagacctttccagccctaaaaatcacgcagccttgtacagcggaaaaacaggcttttggggtcctgggctctccctctcctcaatttccaaacaaagctgggagaggtttccaggccacggtggggcctgggcctgcgcctgcacctgcgcccctgagccacactgcctctcagggttcttggtgggaccatagctcagatggcagcaactgaaaggacagaactgctgcccagatgagatcccatgacgtgtgttctaaatcggcctttagtaatggtgcaggtggcctggtgccctcagcctcaccgcaccacccttttgccttttggtgatgaggctaagtacatgcttgccatatgttgaggtgggggtgggtcagtgcctctccaggggtgagtagttctgcactggccctgcgtatgggtgaggctaaaggaggaggccgcgcagtggggcaggcaacatccaactgctttagcctttttgcccacgtattttcaggatattggctttcagattccaggtgtatgactctgcttgatttttgcagttggcccaatgtgcacctcagccattttctattgattctgtagaaggggactaaaacttacattcagtagaaaattacgtgtgtgtccatatgcctatctgtgcacacacacacaaatatatttgtgtgtatacacatatatgcaaatgcatggaaacgtaggagggagggaagtggaactggttggggtggggtggtgctgaaggagaactttaatattttattttaaatacttatttttttttgagacggagtcttgctctattgcccaggctggagtgcagtggcgcgatcttggctcactgcaagctccgcctcccgggttcacgccattctcctgcctcagcctcccgagtagctgggactacaggcgcccgccaccatgcccggctaattttttgtatttttagtagagacggggtttcaacgtgttagccaggatggtctcgatctcctgaccttatgatccacccgtctcggcctcccaaagtgctgggattatgggcgtgagccaccgctcccggccattttttgtgtttaaatttttttttttttttttaaatcaaaacaccagaaacccctctgtgtagggcagaggttcttaagcagtgcggggcacctgcaggatctgttccagcagacagctggccccaaatcctggctttctgggtcaggagggctgggtggggcccagcagctgcctctcgaacaagttccagggaggctgctgaggtggggcctgcccttcagaaccctgggtctggtggagagactgggagaggcctgagtgactcgtctgcatttgcagcacctgtctgaagagaggcatggagattagagctttcttttctccctacaaccccatcctctttctgagcatttcccagctgcacgtggctgtgaggaacacggggcctgcagtatttcaggagtggctgtatcaatgtgttttctctttttagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtgacgtgcatcctcaattagaattaaagtgatgtataaatatgc

SEQ ID NO: 6028 - DNA, 1697 bp, Homo sapiens
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 6029 - DNA, 1811 bp, Homo sapiens
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 6030 - DNA, 1583 bp, Homo sapiens
atggcgtctcgatatgacagggcgatcactgtcttctccccagacggacacctttttcaagttgaatatgcccaggaagcggtgaagaaaggatccaccgcggtgatttttataggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 6031 - DNA, 1809 bp, Homo sapiens
gctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcgtatcatgtttctctgattgttcacgattcttgtggcctggcatggatgtctgcacatttgaaaaagtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 6032 - DNA, 1950 bp, Homo sapiens
gaaaggacagcaacagtcaggtggtttaccttccagaggctggcaatgctgtttcactggaggacacggctaagaaggaagtccaccagcctgccaagatgaattgccttgaagggccaggtaagacctgtggccccttggcttctgaggaggagctggtgtctgcctgccagttggaaaaagaagaagagaatgaaggggaggaggaggaagaggaggaggacgaggaggatctggacccagatctggacccagacctagaggaggaagagaatgatcttggggatccagctgtacttggtgctgtccacaacacccagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatg

SEQ ID NO: 6033 - DNA, 1913 bp, Homo sapiens
gctggcaatgctgtttcactggaggacacggctaagaaggaagtccaccagcctgccaagatgaattgccttgaagggccaggtaagacctgtggccccttggcttctgaggaggagctggtgtctgcctgccagttggaaaaagaagaagagaatgaaggggaggaggaggaagaggaggaggacgaggaggatctggacccagatctggacccagacctagaggaggaagagaatgatcttggggatccagctgtacttggtgctgtccacaacacccagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatga

SEQ ID NO: 6034 - DNA, 7430 bp, Homo sapiens
cgcgcgcagctggtcggcccgcggcggtgctgcgcggatccggcgtcggggcccggcatggcgggggccggggccaagccgggccggacccggacctaaatgcctctgttcttctccgcgctgttggtcttgctgctagttgcgcttagcgccctctttctaggccggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctc

SEQ ID NO: 6035 - DNA, 4283 bp, Homo sapiens
ctcagctccttttcagtaatttcagttctattttcttactctatcattctggtgttttcattgcattttcttataaaagagatccagatttattttggaaatagatttgaatgacgaaaacatcctatagaagcaaatcctaaacaaatataaatatttgaccatgattatgcaaagaaagctcctgcttcctcctctgtgtcacagagaccctcgggaggaactccagggagaatggaagcttgggagtcatcccaacccttgctcaggtgcgaaatcccctgccctctgcctggcactgatagggacggatcagtttctctgcctggagaggcagcctcctgtgacctggatacattggagcctgaacacgggaacagaagggtctctgggaatccaatctcagtctgttgggcttacaaagtgaccaaagtcaaatgctggtctgtgagagaaagaggaggcagacacatcgggggaccgagaaatactttgaagcaccccgctcaccatggtatggggaagaatttggccacatccctgccaactgctgcttctcttggactgggaaagggtcagttgcttgtttctatcagattcatggacaccaccaagaaaagaggccagtctgagacattcaatatttgttgaaacacagaggtttaactgatcattgaggtacacagggtgataggaagagtatgaacttgagaatctgatggattttgtttaaagttaggactaggctactgactacccaccctgctaattgtcttggggaagttatttaacctctctgaacctcagcttctcatccacaaaataggacactagcacacagtgggctatctatatatatttattgaattgaaatgggagtattcaaaattatttgggttgttggcttaaaataagcagaataattcaattcctgttcatctggaatctaattgtccaatttggagtttcagatgtaacaaagatcctaatgacctaatattattggggtaatcctaaaatttattaggtgatctgcaagttccatgatgattgtatactggaggaaatgcacaatgcacacagaccttcctaggagtaaaagactgatgtgaatttgcagcactacttaattataagtaattgttgcatgaacacacacacaaacacacacccacagaactcacactataagataggaggggcaaataatgacatttgacaaaaatgagctcttgcagagctcaacgagtctaagtttcctccctaatatcttaacaggctacagtatacacaggcttttaagtaatgtacttgttatccaaacactagcagacatttaactggaatccaggagcattttgtcaagaaggaaaagaactaaccaaagaaaaagaaaagtagagagtttcccagctgttttaccacatcacaacttcaaaaaaaccaagcctgtccttgccttgtccctgatggctctgccagcagagtgaatgaattggagcagatttaggttttaaaatgcctcctaatatcatttgggcagattagcttacatggctggacattgtgctcccagccacagggaatgttcttttcctgttggaagctctgacagccactgccacggtgaaatatcaggagcctcctaacatttttcttgatttctttaagagtgaacattagacatattaaaaacaacaacccaatcattaagccctgtgaggttttcctaggagccagctctatcgctttaatcagattacggacaactcattctcatcccagccatttatcttctttgtttacacacacaccaagtggcattcttcttagcatcaaaaaatagtaatcaaaattgagaacaacaaaagacctttcattatttacagtgttaagtaacatctatttgccttcattagtttctaaacaacgaagtacactggttctgattaaagctggcatgtgttaattatatccgaggtctgggattgttttgtctacaataaaggattgctgaaagctgaaatttgaggcgcccaggccccagaaatcacctgcctctatgtgtttcctcagtgagagtttccagcctgagaatggcagaagcggatgtgagcttgtcacagaaagttttttttgctttgttttgttttgtttggtttttaagccctcggttttattgcccattttatgggctggagttaaatggaagtacaatgcagtttgctgtcttactgctcagcactaacagccatgatgagccataattagaagtaaaaccaccacataaataacatggtagaaaaattgccacagtgagaagccagactttggcgacgggaaacttcagcgggtcttgagtatccatcatacttaaggggcaccgcgtattttagcccatatttgtcttactaaagccaaaatgggagccatttagactttcgaacaagcttttaaaaatagagaatgtaggcttaaacagactgcctgctgctaagtgtgatgaagaaacctgtcacctggaggctacgacagctggaagggctgggagggagagccctgggagcccaggggtgaggaagggaagataaacaggagaggaagaggaggcctggactctccacaacagcaaggtctagacatttcactgcaaagcctaagagtctgcacaccgttgagcacagcagcttagacttccgccggggaacgtgtgaggctgggacgccttgcagattttgctttcatgacctgtactcagcgatgaagtgggagcaggtagactagttttttttttttttttaatggagtctcattctgtcacccaggctggagtgcagtggcgtgatctcggttcactgcaacctctgccacccatgttcaagcgattctcctgcctcagccccctgagtagctgggattacaggtgcctgccactgcgtctggctaatttttgtatttttagtagagatggggtttcaccatcttggccaggctggtcttgaactcctgaccttgtggtccacccgcctcggcctcccaaaatcctgggattacatgcatgagccacgcgcccagcctagactagcatttttgagtacccactatctccttggcattttacttccattttaattctcataacagccttaggacgccaatgaaaaggaagagaaaataaagtgtgttctgtgcctgaaaatggccttaaagaaacaaggaccaacagctggagcagagtggggctgcccatacgcaaagagacaacaagtaggaattaacataaggcatatcacgtggatgccatagaactatcacagcaatttcttttttccccaagtcagcctctcttgtacaggggattagaaaacaaacccaagagaataaacttgaaatggaaggaacgtgctttgtagtcgagtgtttttcaaagcctgcatcattttaaaaactgatttaagtatattcatttgctttctaaaataagtcatatgtatgtttctactgatcggccagaatagttaaggtctgtctgatcttcatatggaatgaaaggggacattctttggatattctggaagtccacacgtgttctttacagagtttggtttgctttctccgtttcttccttcctttgcaaaatcaaacaaacaggaataaaaaccaaaccaaaacaaaattaatgaaaacccttgtgttgaggactttgttttgttttaaatgtgtctggtattaagcagtatgtttagtgaaatgactttaaacttaagtaggaaatacagctccatttcacacgtggattttgtctgcatttacatctctgcaggcctcacatgccgtgacaccagacatttttttaattaagatatgaagtgctcattttttttttgtggaactgctgtattctaacaaatttactacacgtctcagaaaacacatagctttgccaaagttggtgagtagcccagcatggtttatctccagcccacagctctttccctgaattcaatactgcaggcacaatttaatgcaaacccaatttatgacttaatgctctagggaccgtagtgggagattgttacattattcttttctaatcctatttgtgttttaatttgctaagtctgtaatgaggtgcatgccttgaatattcaagatctttgacattgcttttgactttgtttaatataatagattttacagtttgcattaaatacccaggtgcttcggtcagtattatctctttattttctcaactagagtgaataaaattacacgatgaaagt

SEQ ID NO: 6036 - DNA, 5718 bp, Homo sapiens
gctgccgtgggctgcgcggggcccgcggtgtgtagagtccgccgccccggagccgcgtcccgcacccggacggtcccgagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttggcaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggccttttcatagccatggtgacacaaaggccctcaagattagcctcctgccatcatgggttggcctgtgatctgtcccccagccaaacccaagtttgtgagagggactctgagaacacttgagcaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctc

SEQ ID NO: 6037 - DNA, 2723 bp, Homo sapiens
gctcccccccagccaagccttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 6038 - DNA, 333 bp, Homo sapiens
ggtgccagaagcccaggaagcacacatcaaggctcgcttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggttcgtgagccacacatctccccacaccaagctcctccatacaagacctcggactgcatcatgtaa

SEQ ID NO: 6039 - DNA, 5555 bp, Homo sapiens
agagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggaaccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgccaggggtccctggagcagccggcgttgggggcgctggaggtcgggaaccgagtacagcgtcgggcgggggacagctcaatcgagctgggagcattagtacccttgattctttagactttgcaagatattcagatgatggtaacagggaaacagatgaaaaagtggcagtcctggagtttgaactacggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcagataaaggagtatttgcatatacataatgagatatcttgggaatgggacccaagtctaaacacaaaatgtgtttcatatacacattatacacatagcctgaaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacactttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttg

SEQ ID NO: 6040 - DNA, 7391 bp, Homo sapiens
atgacctcacggacaaagcgaaggcagaaagttaaaatcagcatatcgaaaataaatcactctagttaccgaaaagaacataggccgttttgggagcaccagccacctccacaccagaactgggctgtcgggggccgctgcggcgcaggggctcgtccgggactgagtcagcgccggggccgagaagttcggcgggaggcgcagggcggggcttcctcccgccgactccgagcccggctctacttttctgagtccacgtctcttcctttggacaggcgtggcagcccgggcccgctcggcccagcccctcacggactgcggcgcgcggctccccggggcccggcccgccgaacgcctcgctctacagccctcacctcgcggcgccgagcgcagcgtccgcggcatggagaccggctccgactcaggtcagaggcccgcccccgggccgcgggggactggccctgcgcgcgcggcggcgcggttaggccgggccgcccgcacaggccgccgcgtgtcgagtccgcgcggggagcgcacgcggggcgggcggcgacagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacg

SEQ ID NO: 6041 - DNA, 6620 bp, Homo sapiens
ctcccggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccgggccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaat

SEQ ID NO: 6042 - DNA, 7039 bp, Homo sapiens
gtcggttgttgtcaagatggcggctgcagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgccatgagggaggttctgggggcgagcagacaggcggcgctgaagtgaaggatgctggcggggaggcccggaacccggagcgcggtcggggaactgggcactgaatcatcggacaacctcgacagagcccccctcggccctcgggagagcggcgggcatcaccgacctggctcttacctagatatgaaaatccatctggagaaaaatttagaagaagagcgccagatattactgcagcaacaaaaaatatgtcgaaatcgagcacgtaaatattttgtggagtcaaatcggagaaaaaaagcttttgaggagaaacgaaaagaacaggaagaaaaagaacaccaaattagagaacaaatacttcaacaaagaaaacagaagtttgaagaagttactgaaaaattccagcgtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaatttggtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagaccattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcagtgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaacctctttattaaacctctaacttactgataagatgtttatgaagtatggcatattttgatttttttaattgtaataaatattcttaaagttaccacatcccacaaaatggcccttggtggcagcaatagagcaaaggttacctttttgtatggtgaagggaggccttcctatggctgtacaattacatcgattcttccaaatttcatatttcatacatggcactttggcataccgaaaaaacatgaaatttttcattaaaatgccatgaatcaagccagggccgttggcttatgcctgtaatcccagcactttgcaggccgaggtagacagatggcttgagctcaggagttcgtgaccagcctgggcaaccctgtctctacaaaaaatacaaaaattaaccaggcatggtggcatgcacctgtagtcccagctacttggggtgctgaggcgggaggattacttgagcccaggaggattacttcaacctgggaggttgaggctgcagtgagctgtgtttcgccactgcacaccagcctgggtgacagtgtgagacccagcctcaaaaaaaaaaaaaaaaaagtgatgaatcaaaattagaaattaagagttttaagaaaacatgtggccttttattaataacactactaaattttggttcctccatagaattagttttgaaacacttgatgtagtgagaaatgcattaacatgttgaatgcctaccatgtaccaaattttgtgcatatattttttatttaatctgaccagccacccaaaccatgggtatttttgtctccactttagagatgagaaactgagccaaggccacatagctacctacagtgacagaatcaaaattcaaactcaggtttatctagttccaaaacccatgttctttctgccacaccatgttagtagaaatggaaactattggatgaaatgaggaaaaacaggaaaagaattcactttttaaatgaagaaattagtgaaaaaattgacctaatgaaggaaacatttgtgctttcctatatttttaattttaagaataggatttcggaaggcgacagaaaatttagttcttagacatttaaatagaaagttgtgtgcccctatagaaaatatttgagaatttcttatactatcaagaaaaaattctgtgaattaagatgtaatttataaaataacatttcaatgggggtaaacaggccagaagagtgtgccaagttgtttgtgaatcattccaagcacctcagatgaaaactcacttttattaaaaaaaaaaaagacaagggtttatattcatatacactagtatatatgtacacagcagcatcctgcatgccaaagtagcttcaccgttagtaatccctcactttaatacctcttaggaaccaaagaatgcctctacaagcaaaaagatagttgaaaatagttaagatccaaagtcagaataggccaaaaaaaaaaaaaaaaaaagcctaaatagtaagctggtgaaacaagataagatttgcattttactagaacttgcacattatgatattgtccttttatgaaactgtcatatgaccagaattcttctgtaattctgcccatgactcctccagaattttagtagatacagggtgggttcattaagagtgataaaagtgggaagacataaagagcctttgtgaattaaagtggaagagaataacactttgcatgctataaacgtgaaaactaacatttttggccagacacagtggctcatgcatgtaattctagcactttggaggccaaggcaggaggactgcttgagcccaggagtttgagaccagcctgggcaatgtagcaagaccccatctctatataaaatataaaaatgttggctgtgcacggtagcttatgcctgtaatctcagcactttgggaggccaaggcaggcagatcatgaggtcaagagatcaagaccatcctggccaacatggtgaaaccctgtctctactaaaaatacaaaaatagctgggcatggtggcacgcacctctactcccagctactaggaggctgaggcaggagaatcgtttgaacccaggaggtagaggttgcagtgagctgagattgcaccactgcaccagcctggcaacagagcaagactccgtctcacaaaaatgaataaataaaataaaaataaaaatgttactttttaaaaagtaacttttttaataatataagaaagaaaaatgccctttcacactgaatcttcaagttctaaggaagaaaagagtctcctttcgaatgtgaagaagtaaatttagaggaaatcaaacaagcatcactttcctcagtggaaaaacttatgaaacttcttataagagagagtaatctcaggccggacatgctggctcatacctgtaatcccagaactttgggaggccgaggcaggtggatcatttgagctcaggaattcaagaccagcctgggtaatatggcaagagcccaactctactaaaaatacaaaaagaaaagaaaacagccaagcttggtggtatgtgcctgtggtcccagctactggggaggctgaggtgggaggatcgtttgagcctgggaggcagaggttgcagtgatcaggaattgtgccactgcactccaacctgagtgacagagcaacactctgtcttaaaagaaaaaaaaaaaagagagagatagtaatctcttgggcaaaaggtatcaaataattgaaagaaaagtttaaacacatttccgagaggcagggcaactaataactggtcagaaaaatttagacggtcttcattttaaaattggcatcaggaaggattaccatgaacttattttaaatccatattgtaccagaatgactatgtctgtgtttcttaggaatgttgaagctttttgtgaaaactgtactgtatacatatataaatatacacacacttacatgtatgtattttgatagatattacatggactaaattttgtcaatttcatgtaatttaccctttgcaataaaaatgattcattaaatat

SEQ ID NO: 6043 - DNA, 4568 bp, Homo sapiens
cgggccggggcgcgcaggtcccgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtctggggtcctgaggctgctggcagactatgggtacaacggccagcacagcccagcagacggtctcggcaggcaccccatttgagggcctacagggcagtggcacgatggacagtcggcactccgtcagcatccactccttccagagcactagcttgcataacagcaaggccaagtccatcatccccaacaaggtggcccctgttgtgatcacgtacaactgcaaggaggagttccagatccatgatgagctgctcaaggctcattacacgttgggccggctctcggacaacacccctgagcactacctggtgcaaggccgctacttcctggtgcgggatgtcactgagaagatggatgtgctgggcaccgtgggaagctgtggggcccccaacttccggcaggtgcagggtgggctcactgtgttcggcatgggacagcccagcctctcagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaagaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttgttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgattttttttttttttgtacagagcttttaagcattaaaaacagctaaatgtg

SEQ ID NO: 6044 - DNA, 6034 bp, Homo sapiens
gggcctgcggccctccctgcaccggcggacgctcctctcagtcttggagtctcttcgcccaggtggctgtggatccggtacgggagttgccgccgcggtccaactccccgctgccgcccagcgcatccgctcgcaggagcgccggcggccagcagtgcgctctgcagcatgtcgctacatgcctgggagtgggaagaggaccccgcaagcatagagcccatctcctccatcactagcttttaccagtccacgagcgagtgtgacgtggaggaacacctgaaggccaaggccagggcccaggagtctgactctgaccgcccgtgcagcagcatcgagtcctcatctgagcctgccagcactttcagctccgacgtgccccacgtggtcccctgcaaattcaccatctcactggccttccctgtgaatatgggtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaagatgctgcttttaataaatgctttcctacagatttttacaaaaacatctagtaaagggaatgaggaaagggaaccctttttgactgagcccctctgggtgcaggcacttcccgtgtgacacatcacttacttctcagaccaaattctgacccactcagccaacctgtggtgtggtggtggctgtggtggttatcatagttaccatttttttcagtgaggaaaagaactcaaagaggttaagtaactttcctaatcccacacagctcagtggccaaacagggatttaattattttgctttataagatctaccacaatttatgaactggactttatacatactggtaaatcataactaaatattatatcaatatgttttgatgattgaaagctcagcatatattttggtaaaattatgttgctttgttccaaaaaagagtaatatggggtgaactccccccctttttttttctttttagagaaaattcagactttgttcgtttttttgccatcacgtgtcttgtgcgccctctcctggctactctgcagaagcgcgtgcgttggtcttttctgagctggaaccagcattcatagagaagggggcaaaaaccccgtaagtcagagcctccagttcagttccacaggtgccagtcgtcatcctcctctcgcgctcttgggttggtgtcaattcagtttgagaaagtgctattaacttttcagtttgcactttttttttttttgagatagggtcttgctctctcacccaggctggagtgtaagtgacatgatcatagctcactccagcctgaagcaagcctcccgcctctgccacccgcatagctaagactacaggtgcacaccaccacacctggctattttttttattttctgtagagacaaggtcttgctatgttgcccaggctggtctcaaactcctggtcacaagtaatcctcctgcttcagcctctcagagttctagaattacaggcatgagctgccgcatttggcagtttgcagttttaaatgactttttgaaaatgatacttcacctacagcttgtccttcctgatcaccttcactttctcgtagcatcagaacctcttgagaggcaacagtgacagagagtaaactttcagagggtcttaccccaccccacgctccagcctgaccctccagcatacctattgcacacagtagctttgagcgaacgcctttgctagctgcttccttcgtcctacagtcccaaggaggaacccatgatcctcctgggggagcgtaccatgggacctgccccgctttggattttactgtgagaggaaaaagaagttcaaccatttgggcctgcctggcatgactgtttccagcagaatgaagccaggacatggtcccctctctcttttttttttttcgagatggagtcttgctctgtcgcccaggctggagtgcagtggcgcgatctcggctcactacagcctctgcccccccaggtttaagcaattctcctgcttcaacctctagagtagctgggattacaggcgcatgccaccatgccaggctaatttttgtattttttgtagagatggggtttcacaattttggccaggctggtcttgaactcctgacctcgtgattgtcttacatgtccgtgtgaagagaccaaacaggctttgtgtaagtaacaaggctgtttatttcacctgggtgcaggcaggctgagtctgaaaagagagtcagcaaagggtggtgggattatcattagttcttacaggttttgggataggcagtggagttaagagcaatgttttgggggcagggggtggatctcacaaagtacattctcaagggtggggagaattacaaaaaaaccttcttaagggtgggggagattataaagaaccttcttaagtgtgggggagattacaaagtacattgatagttagggtggggcagaaacaaatcacaatggtggaatgtcatcagttaaggctattttcacttcttttgtggatcttcagttgcttcaggccatctggatgtatacatgcaggtcactggggatatgatggcttagcttgggctcagaggcctgacagtgatccacctgcctcagcctcccaaagtgctgggattacaggcgtgagctaccgcactggacctagcctcccctctctataacctgccccgtcatgtacaatgctgtacagtgcaggggttcacatgtaagaactttggtgaccaaaacactttgatcatggctcagccacttaccagcaagttacctactttctctgagtctcactttcctcctctgtgaaatgggggtgattactcctacctcagagcgttgttttaaggatcacaggagctgacgtgtgtaaactgctagcacagtgggacccagggggtgcaggtgtggaggcagcagctgtcctgaggccatgtgtgtgggccgctccattatacccatgacatagcctatggtcatcgacagagaacgggtcagctcagcaggccagttgtatgtctggttttgccagaaactaatagcataagattatttactgtaagcccagcataattatttttggtaatcatcttcaatttcaaattaggccatagatcatgtatgtataccttattagtaaatattggttggctagtaacccagtaagattctagaaagattctgtgtctgggaatgagctcttattttaaaaggatagtattgcatagcggaggggccccacttagcccaacagaactggtttggatgctggttctacaacgtattttctaagagaccttggatgattgcgtcagaactctgggcctcatttcccccatctgtaatgtggagatgacagcaaccacacaaggttaaggatgaaatgacattagcgcatgtttgggactggctgttggaggagcacaaacattcccttacaccattccactcttaaccagggctcttaactcagggggcttgtgtctgctggggacacttggctgtgtgtggaggcattttggttggcacgactgagagtgggatgccactggcatctagtaagatactgttaaacatgccataatgcacaggactgtcccctgagcaaagaatggtctgccccaactgtcagcagtgtggaggctgtgagcccgcagcctggaattctgttctggtgtatgtctccctgactctgatgatttgagcactttttttttatttttatttttgcaatggggattccttctaccttgagtagtcttttttttttttttgagacggagttttgctcttgttgcccaggctggagtacaatggcgcgatctcagctcaccgcaacctccgcctcccgggttcaagcgattctcctgcattagccttcctgagtagttgggaatacaggcatgcgctaccacgtccggctgattttgtatttttggtagagacgaggtttctccattttggtcaggctggtctcaaactcccgacttcaggtgatccgcctgcctcggcctgccaaactgctgggattataggcgtgagccaccgtacccggcctacccttgggtagtctttcatgtgaaaaggctcacaaaattatagaacacaggcgtaatgggtgacagcttttatgaatcagctttgttaaagaggatcctgcgggagcatgagggctacccccaggagctgtgcacgcctctgttcacagcctgtgcagatggctgtgcacacctggcccgggacttgttttagaagtgcctactctttctgaatgtgagcgacttggcttttacatgccctagaaatacatttacaggcatgttgaaaggaatagactgatctttttgagcaccatctcatatatcatctttcttaatcctttaaacccaaggaaggtggtgtctatccccattttgaagatgaaattgagccttggagactctagcttatcacatgacaaagagtcagatctgggattcaaacccaggtcaatcctgcctccaaaacttgaggtgattttttttgtttatttgttttgttttttccttacctagtacatctctgactggtgaaatacatggataccttttatagaaaaagcattctgggctgggtgtggtggctcacgcctgtaatccctacactttgggaggccgaggcgggtggatcacgaggtcaggagatcgagaacagcctggctaacacggtgaaaccccgtctttactaacaatacaaaaaattagccaggcatgttgtcgggcacctgtagtcccagctacttgggaggctgaggcaggagaatggcgtgaacccaggaggcgtagctagcagtgagccaagaccgtgccactgtactccagcctgggcagcagagcaagactctgtctc

SEQ ID NO: 6045 - DNA, 6429 bp, Homo sapiens
gtctggtggcccgacccgcgccgcccgcggctcccttatgtctctcgccgtctccagcctcagtccctctctgtctctctctcagtctctctccctgtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagcaaattttcttttttttaatttttaaaacttcattgtattttatgtttagagatggggcctcactacattgcccaggctggtctcaaactcctgggctcaagtgatcctcttgccttggcctgccaaagtgctgggattgccttttccgcccaccccccccgaccccaccagagacagggtctcactctggtgtccaggctggagtgcagtggtgcaatcatagccttaaattcctgggttcaaccaatcctcccacctcagcctcctaagtagctgggactacagttatgcaccaccatgctcagcttattatttatttattttttgtagacatggggtcttgctatgttgcccaggcaggctgatctcaagctcaagtgatcctctggactcagcctcccaaagtgctgggattatacgtatgagccactgtgccccaccctcatacaaatttccatgttggcaactgtagctggatctttctggagatctctgaaagacagcatggaatccttgaacaccccctgaggcgtgaggcatccagagcatttatctgccaaccctcaggagctggcactcgtagacagcacgcacagccagctccattggtcttggcaaagagaattgcctcctggagccagaggccggttcctgtgcttagaaaggaaggacatgtcttctgtgctccctgtctcacaaggcctcttcagcaggcatgggaccttcattctcaagttcaaggaaccctgtggaaccttgtccttgtcctccagagagaatcctctccgccttagaggtccctcctctctctcacctccccaccaagcctccctgaactcaatgtcttctgtccccttccctgcccaacttccacttctctatgcccagcctctgtggcccagtaccattggggttctgtgggcagctgggtcctggtggttggggaccgtgggaaggggcctatctgtcggatcttagatggagcatccagaagccccacccttcatactggccagagtggcccctgccagcgcctctctggagtgtcattaagctgaaagtgtttgccttacctctgcagtaggatgcattactgaagtggcctcttggtcacctagctctgaattttcctggctccagaaagaggctgtggggcacaggtcccccacaatgaggctgtgaaggggagagaggcaggcctgggccaggcacaggaggacaactagggcttctcaggagctgtctcagccaagagtcacacacttgatacctaaaatggcttcaggaatcttccaagactgaagacttccccaggtgtggtctagggcctgcctgcctcagagccatgagcagagccggtcaaaaggcttcctagggaatcctaccccagacattaaaatagactcttggtgctggcaggtggctggaatctgcgtttgtagccaagtgctcttcctgtgtgactcagcaaagtgggggtgcatttggggaacacccggggctggggcctgagtcctccacccaaagccaggtttgattcttgcattcccctccctgccttccatccagacaggcccaaagatgcaagaggcgttgatcagcccatctccatccatgcctgttgcctcagagagggccgacggcttttaaaatgctgttgccatagcaacagcatccagccagtgggtaccacaggcagggagccacagaaactggggtgctgggatggaaactgacttgtgagagaccacagctactgctagaaggaaggggggcaaagcgggcacaggtaatctaagaatacttgggcgggaggagtccccaaggttaccttgtgcatccctctgtccccagaaagaactgtaccccaacaatctctcccctcactgcatcccctggggaagaagggaatgcagaaatgaaatgtcataatgagtaacaatgtataaaaatatcgaataataacagctaacatttcttttgcatt

SEQ ID NO: 6046 - DNA, 4853 bp, Homo sapiens
cccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcaggggagaggagaggcctgatggggcagagctggacgaagtctgctaagagagatggaggctgtggcggactccttccaactcacgatttatcctcagctcagagtgtattttgaatatgagcaaatgtttatgtacgtatgagatttcaagttaataaatcatctctatggct

SEQ ID NO: 6047 - DNA, 3396 bp, Homo sapiens
tgcgcgcgcccgaggacgtacgtcatcggcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatg

SEQ ID NO: 6048 - DNA, 878 bp, Homo sapiens
gtctggagccggtgctctgcggcggggcgggagggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggct

SEQ ID NO: 6049 - DNA, 3116 bp, Homo sapiens
acccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaaacgaattaatacatgaaaggacttggaatactgcttgacatatcgtgaggcagagacacaaagatatggaagaacattggacagatttacatcgatatattaattaaggtgatttcagagttggagcaggagaggaagccttatagatatttttttttctttttgcttgcttgtattttctttttaattattattcagtatttcaagtagacagaaaagtacagaggataatacaacaaatatccaggtacccaccacccagcatttttacatagtagcatttgatgttttgaaataagacataaaacattccaaataccctatcaccgaggatcctgcatcctcttcttttcccagaagtgaacatttctctgaatttgatgcttattatgcccatgcatgttgttatacttttactacatattttatgtagctacagcataatatgctatgtttactttatatagtgacctcatactatacatatcctcatgcaattttttagactctgtttgagaattatatattttgattcaggtagcttaagtttattttagctactcagtagtaatgtattctattaatctactaatatatatttcttgtctatggaca

SEQ ID NO: 6050 - DNA, 3976 bp, Homo sapiens
gcctcgtgggagtggtggttcgacggtgtcctatgcctgctttccttgcgggcggaggaactacaattcccagcgtgacccggaggcagcccgggcagaagggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagcctacttttggtcctgacagtgtggaacactggataaagagagtggagaaagcctcagagtttgcagtgtcaaatgcattttttactagaaattcagatttacctagaagtccctggggccaaatcacagatttgaaaacatctgagcaaatagaggatcatgatgaaatctatgcagaagctcaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaagaagtaagaaaattttgtgtacattttcttcaaaagaagattttcagggcctggtttaacatggtcagggaggtgaagatcgattctcagggcaagcatgagattgcagcggagcacagtgacaggaggatcctctggatcacccttcggacatggaagaagtttgtaaaatttatgaaagaggaaagagtaaaagaagaaaggcgacagcaacttcgtaggaaggtagttgaaattcttccagacttccaggtacctggaaggtaccacgagctatatcagcaatcagatacttggtccttgagtaagacaagtctggtgaacgaatgagccagattagtgtaatatttaggacaggaagctcgactagtctgtatgtgtgttatctccacccacccacacacatacatacatacacctggtttattctctacgagctacttcttagatcaaaggaattattttgagaatttttattcccttctttgacttttcctggattgctagtcattcactatagcatttatcacagtgggatcatccaaaggaacattctagagatcgtctgttcaaatatatcctatatatttttagcatagtaaactttaaaaaggacaagtgtttgcctgactgagcctgtgaagaaaatgtgtccgtatagcacgacaggagttgctgatgtgaccttaatgaaacagaaataaacaggggtgagtgctcggaaaggaagggcgggccaaggcactcagccttctagtgcagtagcatcagtgacacgcaccccaccagacctcgtccactttcaccacccctgaaggcagaccatgtatgaaaaggttctctacacagctgctgcagaggacagcagcttatcctgatttcagagaaactgaggcaccagagatgcttctcttccgtgcaccttgataagcatgaaggacattccaaaaggtaatagctctatcatgacagtccagcaattcattaaattatctgttcatgctcccacctgcaactgctgaataatacactcagtttgtcttctagtactcagctcagtttgatctagatattgagatacctatcttgaattcaaagaatgttttcatctttaagatgctataaagactgataaaatgctctcttctatgaattgtgttagagaattacctgctagaaaaataatttttcattataaaatacacatttattatataacaaattcaagtagtccataaatgcatatggtaaaatgagaaagtcctgtgcagtcctgagatgattactcttatttggtgtgctgaaaatttgagttgacaaaataaaattctgtggttttttaagtgaa

SEQ ID NO: 6051 - DNA, 5120 bp, Homo sapiens
gcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattacgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcagagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtaatcccaacactttgggaagccaaggtgggagaattgcttgaagccaggaatctgagcccagcctgggcgacaaagcaatacccctatctctacaaaaaataaaaaatagccaggtgtagcgacacacacctgtagtcccagctgctcaggaggctaagcaggaggatggcttgggcccaggagttcaacgctgcagtgagctatgattgcaccactgcactccagcctgggcaacagagtaagaactgtctcaaaaaaaataaaaaatagaaataaattttaaaaaaagaattacccatattctctttgtttttgtttattcacattaacctttattctatctggaatttattagagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccaggctggagtgcagtggcgcgatctcagctcactgcaagctccgcctcctgggttcacaccattctcttgcctcagcctcccaagtatctgggactacagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatg

SEQ ID NO: 6052 - DNA, 2188 bp, Homo sapiens
cgcgccggttcggtccccggggctctgcgggcgccgggcagagacctgcggccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccagatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagactttccacagctgcccaagaccttccggctccagaggagggacggagccatccccacgtccctgtggctctcaggacgccctcctctga

SEQ ID NO: 6053 - DNA, 7927 bp, Homo sapiens
ggggccgcgccgggtagcgtttctttttagtgcctgaggcagctctggctcggagagccttttgctagccccacggggacctctgtgcacggatggacccgcccggacctggcgggaagcggcctggcaggcggcggccccggcggcatcagcagagacaggacggggccgacgccgcgggcccctgaggcgtgcgtgcccaccgggcccggcggcggcaccatgatgccgggcgagacccattcggcggcgcccgggacggcggcggacctgtcgcgatgtcagggctgcgcctctctgcagcagaatttgaatgaatatgttgaagcattaattaccttgaaacaaaaaattatcaatacagataatttgttaacagaatatcagaagaaatgtgatgagctgcagtttgcaagaagagagaatagtaatctgcatcaccaagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaaactcaggacttcaagcaactgagaaatgaaaagaaaatacttgaaaaggaatttaagaagacacaggaaaggcttgacgaattttctaaacagaaaaatgaaaaggagttgagacatattggaacacaaatttcaagtgattcatatggaagcatagataaaagaaaagtgaaactgcttctgaaggaactctggctctgtgtaaacacaacacacagactacctggtgaaggcagcaggtgtgtcccagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctgcaattgacttcttcaaacttccccctcctcttctgtcaccagtgccctcgccccctccgatgtcatcacctcacccgggttccttaccgtcttcatttgcacctgaaacctactttggagaatacacagattccagcgataatgactcagtccagcttagaaattctgctgagtgtgtttcagaagatgatacaactgaatcacagaattattttggctcattgagaaaaaataaaggaagtggcacatgggaggaaaagcccaaatcacatgaagctatccaagctctgaatacatgggaagtaaataaagtgacaacttctggactcgagactttcacagcaacactgagagaatcttctgccacacactccttagttggtgaaaaacactggaccacagcatctcgatccatgagtgatagaaaaagagacattttacatgagacaaaaacacaaatggaggttagggagatggataagtcagtacaaactgagaagaccattcataaactcactcgaggtctatgcattgagagattgtctgccagccctgcacaagagaaggaagctgcccctgggaagtctgagttgtgttcttctccccttggcaaaaggccattaaatgaactcatggaatctgaaggaaaaaccgtattgtctaaaatgatgggatcgcccaaatcagagtttactaagtggacacgaattaatgaaatcacttctgaaccagaccgtatcacagtttctggccattttcacagactatctagagaattggaaaaggaaaaagaagatactcaagggttcactttaggagaatcacctgaatcagaagatgatgactcaggtgatggaatggatgtagcagggcttgacattgaaaccagtttttcttcctcttctaccttggtagcattgtctgttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaagactagccatcagttacaaaaggcaatgccattcctacaaaatagaggaccaacacccaagcctgatcttcttagagaaaataacaatcctgtagaattcaagaccactgcatcggtgttgcctaatcaagtatcagttatcacaaaacagacaagacctgaaaaggttcagagtgccaaattggaacacttgaggccacatagggttgagcctaccttagtaacagaaaatagtggcaacaaaaccggtatgtcaactgtagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggatattactgttctga

SEQ ID NO: 6054 - DNA, 1509 bp, Homo sapiens
cacgccgcccctcctttccctttccgctctctccgcctccggaagcgcgggcgcgcggcgccgggagcccgttcagggccgcgggagtgcgccagcgccgcgcgtggggctgtggtggccgcggctctcagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccgggaagcaaaagtacaattcctagatcggctgatcatcccccaaagttatatcacagtgctctcaacagacagaaggaacaacaaaggattgagagagaaaacttgactatctcgctctgtcacccaggctggagtgcagtgacgtga

SEQ ID NO: 6055 - DNA, 3258 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttg

SEQ ID NO: 6056 - DNA, 4153 bp, Homo sapiens
tcgcccagaggttgacagaggaaggtgggtgggggcctagagcggtgggtcatggctggctgcacccgcaaactcactcacctccgtaaacggatccatcgccccaggcgtcggactacgagacgatggaaacggtggttcaaattcaggaagagaaaaggagagaaaaggccaagacctaatcataaggcagtggcaagaagagctaaactcaagttctctacctcagaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcaga

SEQ ID NO: 6057 - DNA, 3988 bp, Homo sapiens
agttgttgcctgacaacacagacgacagtaacttaattcgaaagacaatacttggaggcggcccccgctccaggcaccagcccagcagctcccccgaactccccaggagctcgcgggcgagcaacgccacagcccagagcgagctccgcggaacccccagccccggggaaggaagctcgactctccgcggggcactccttccgggctccgggcccgactaggccatccgggaggccctggagcgccggggccggagaagccctgccccccgccgaagccccgccctgcgcccgagcgcccgccaatggcagggcgcggtgcggcgcgccgaggtgggacggcggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctgaactggtgtgatcgtgtctctgctgaatggtggtggggatagctggctccaccacacacacctgttttaattaggctgggtaatgtgcacggagagcaaagatcacagactaaggagcagtcagtcggatatttgctttgctggcaaagatttaaaccaagaattaattatctttggacactataaagattttgttcccttccttatagcaatataatcatgacaggccatggttaactacatcagatacacgtagcagccgtgaccaagacatggtgccctaataccaagtgttcttgggttaaag

SEQ ID NO: 6058 - DNA, 2991 bp, Homo sapiens
ggcgtttcctctcggggctggcggattccacactcggagctgcggctccacaactcgctgggcggcgaagggcatggggagggggcgggtctcgcgatcgtggacaacaactcccagcatgccctgtgctccgctgggccaagtctcgcgcgagatcccgcggtctccggaggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaat

SEQ ID NO: 6059 - DNA, 6683 bp, Homo sapiens
gacgtaacttccggtgtacacagccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataata

SEQ ID NO: 6060 - DNA, 7841 bp, Homo sapiens
cgcaggccagggccgcccggcgctcggcagccgcccgcagcccctcggagccagaggagaggcgcccccgccggccgccgcgccgcccggcagcctcggcaggtagtgtacactgataaaggtagggcgcggtggactctgcccctgtaaccgttccggagaatgcgttgagaatgaagacaaccagttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacaggctgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttacagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacattttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacagtttgttgtttttatttctcatagcaaagcttcttttgtaaagaactccagcttccttttactcatgagcatccgtggaagagcaagtgcccaggttacatttgttctagatggaggtcatttagctctcattgcagacactgctgaaaacattgtgcagctttgctagggaagaaagtggtgtggcctgctgagaaatcagcggctcctccccatctcacccccagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattcaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatctgtaaacatgtatgaggggacttttaaaagttcatggaaaatggaattaaaagaaaaataaaaaaatataaacttta

SEQ ID NO: 6061 - DNA, 8325 bp, Homo sapiens
ggagagatagggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggagtccaggaggctcctgcgcacccccgaggcccccgcgcccaagccccggccgtcctctaagccgcaagttatttctgcgcccgagagaggcgggctcggataaagtcgggacgccttctggtacataaagtttcatctgctctcctcgctcgcacggtccctgccgcctggcggccccctcctcccacggcgggcgcgggcggggagatggccgccggcgcttcccggcgcaaacgggcgctgcgcgcgtagccgccgccacgctgacctcccgctccagctggctgctgctcggagccctagcagcgggcgaaggcggaggcccagaagggcaggagaccgccgcgacaggagcccgagggtccgtatggcttctcctcgccggcgggtgctgtgcgccacggagctcgccaaaggcgcttcgggctcggagcggctctgagccgcgccgcctgctgagatcgaccgcctgctgagccgttccgtggagctgcgggcaggaacccgaggagcaggaggtggcggcggcggcagtggctgttcctcccagagggcgatgtggccggccggcgcgggcaccaagctgccctgtccccgagactctgcgctccggcgggcggctttctctgggaacctcacggccctgccctctcacctcgtgcccgccggccgcagcgtccgggtcttcatcagcgccaaccctgaagatacgggagcagaaagacaggcgctaagagaaaatgtatatcctaaactgagagaattctgcagagaaaactatggattggaatttcaggtcatagatctgtactggggagtggaagaagatgagtgggacagcccagagctccagaagacccgcatgaagctgctggagaattgcttgaaaacttctgcaggtccatgttttgttggactattaggtgaaaaatatgggaatatccgaatccctggagaagttgaagcctcagagtttgaaatgattttggatgccgccatagaggcaaagctggagaccaagttgctggaggagtggtactgtcgagatgagaactcggtgccagcagcctattacctcagacccaagtcagaaatgctgagaagcaatagaaatgcaatgcagccttctaccaatgctgaaaacgagaagacatggcaagagatatcagatgagatcaagaagatatttaaggctgctgtaaagctgttacacgaaaagggtaaaatgaaacacagccaggctaagaggtacctgttctcagctatagaggatgagtttgactttgctctgggaaaacaaactccagcatttctaaagaagtgtgtttgctacattaggaaaattgctaacattgagcgctttgtgaaaatcccagagatgggaaaatacatggatataactggaacagaaccgaggattattcgggacccagaagcccaagagaagctgataaaactcagggatgaatttattcctactattgttgcatcatctaatctgagagtgtacacatctgttactcattgtgacatgaaactaggctactcccaagaaatagaaaatcattacatcgaaggacttggtaaacaattttatgaggacatgattgatataattcaggcaacgatacaacagaattttgacactgaaactgatacactctatgatgaaatccttcaacattcatcattatgtaaaacatacgcctccttctatgagtacaaatgtgaatctctaaacatagtgcataactacattcttccaagcaaagctggacacatcaaccctcttattatatatggtgggccatgcactgggaagacccttctgctagctgaagtagcaaagaaggcttatggctggctacatgaggacacaggaccagaatctgacccagtagtcatcgtgagatttctaggaacgacagacatgagctctgaccttaggactctccttctaagtgtttgtgaacaattggcagttaactaccggtgtctggttcaaagctaccctaagaagatccatgacctctgtgacttatttataaatcttttgaatgagtcttcactgcagagacctctagtcataatattcgatgcactagagcagctctcagagaatgatgatgccaggaagctttggtggctcccagctcacctgccccgctttgtccggatagtcctttccacgctgcccaacaaacatgggatcttgcagaaactaaggtgccttatccatgaagaagacaactacatcgagctgattccccgagacaggaagatgtgcagccaggtcctcaaacaccagctgctgcgcgtcaaaaggaaggtcacatcaggccagcagatttatgtgaacaatgcattatccaagtgcacactgccaatgtttgtgaacctgaccttcagggaggtgaggcactggagatctcacaaagacgtcgatgaatcctccctctctgtcaccgttcatgaaagtatagagcagttattctggtccttggagaagaagtgtggtcagaaactggtctctagggctcttggttacatcaccatggccaaaatgggtctgagtgaaatggaactggaggatgtgttagccctagacaacagtgtaatgagtgagctcaaagaaaacaccagacccagcaatcccctgagagtaccttacttgtacattgcaaggctcaaggagggtctcagtggatacctaatagaaagacatgtgaaaaatgtcacactcctagtctgggccaacagacacctgcagctcatagcccagaagctatatctgcaggatgacaatgacctgcgtgaaatgcacaccatcttagcagattattttctgggggtttggtcagggggcaggaggaaagccttctgccttgaggacccctacttgaatggctgccttgacttggagaacagaagtttgctggaggaagaaaagcacttcatggaacaggcttcctttgacaggcaggctccagaccagccctgggttttccagtgtaatcccctggaacctgacatctttttcgttaatcatcggaaaatgtctgagctgttgtaccacttgacgaggtgtggaaaaaccgatgacctgctttacggcatcatcatgaacttcagctggctttataccatgatcaaaattggccagtttgacaaagtgctttcagacattgagctggcttacaactactcgcaagagaaggagctgaagttcctggccaacaccctccgcagcatcaaaaacaaggtcactgcatttcccggctccctttcagcagagcttcagcaaagactgctgcctgttgtaagctccctgcccaaacttagacatcttcttttagagtgtgataaagatgggcccaaatattgctccattgtaccactgcattcatccatggatgtgacatacagcccagagcgtcttcccttatcatccagtcacctgcatgtcacagagatcctgcctacctgtaaccccagcactgtcctcacagctttagaaaatggttccatcagcacctgggatgtagagactcgacagctactcaggcaaatcaccacagcccagtctgtcatcctgggcatgaaactcaccagtgatgaaaagtaccttgtggtggctacaacaaataacaccttgttgatttatgacaatgtcaattcttgcctcctgtctgaagtagaaatcaaggggaccaagcatggaagcagcgccacctacatcaatggatttacactgtccgccaaccacgcccttgcatggctcgaagccagcaaagatgtcactgtcatcgatctgctgtacggatggccgctttaccagttccactgctggtatgaagtgacgtgcgtccagtgctccctggatggtctgtatgctttctgtggccaatacctgaacacaaccaccatatttcatttagggagtggagaaaagttatgtacagtgacatcagaattttcaggtggatttgtgaagtttcttcttatcttggacacagctcaggaaatggtcatggtagacagtgaaggaagtctttctgtttggaatactgaggacatttccagcccccagctgactgatgactttgattgccgaagagaagacagtgaggtggtcagcattgagctttcagaagaccaaagtgcagttctgatctgtaaagccctcagcattgagctcttagatactggtctgtggaaggtggctgaaaagttcagagccaagcacaacgaacgctttatatctgccgtgctgtctaaaaatggagattgtatcatcgccaccatggaaaatacctcagctgtgtttttttggaggcgggacacaggacagtgtatggcaagcttgcaggaaatctcaggttccattgttaagttagtgaaatccagtcaccacaatatgctactgtctttatcaaccagtggtgttctttccatttgggacatagatataatcacagctatgtccaacatagataagactggaaaacccatccaaagtctgttgttgcctgctagaggggaaatcatttactccctggatggatccgattgtgttcataagtggaacttcagcagtggcttcatcgaagcagtattcaagcatgaaggaatagttgaacactgtgtgttaacatccaccggagatataatggtgacatcagatgacaaaagcagccagtatgtctggcacaccagcagtggtgaaaacctttttcgaattaacgggcagagaatatctcagctgctgattacacacaatgaccagtttgtggtctcgctctgtgaggaaaatgcctccagggtttggaggctcgccacaggccacagggtctgcaacattctgaccactttgcagaatgcctttattacctccgcaaataccttcgtggtgggaatgactaaaagcaaagtgttggcagtcagtctttggacaggaagtatcaccaagaaattttgctgtgaagatgggaccaccatcgtgaattttaaattaatccctgactgtcctgatatcatcgtgtttatcacatcggccgagactgtgaacatctggagtctgacagatgaagtgatctgtcggcgcgtgcaacttccaaacaacttcttgaaaaatctggaggactttgaaatttctcccaatggaaagctaggcattatagccaggggagatgaaaacatcaatgtgctagatttatacagtggtaaattgcgggtggttcacgcctctgggatcatctggcggcagaggttgtctcgggatggtcgctacctggtatacatttgtttccgaaatggggaggaggaggatgaaaatggtgcaatattcagtttaattgtaatgagactggcagatggcaaaaatatcggtgcttgttccctttacaaaacaccaactttccttgcactctcccagaggcacctgaacatcattgtgggctttgatgatgggagtatagggatctacacggtagtagaccgtgtagatgctgcactgaaaatcaaaattgccacttcaaatagcagacaaattttcaacaatgcaacacacacctccaggccaaagtgtaacagttattgttttaaaatatctgtggattgcttatggagagagtccactgaggtctttgcaagagacagccccatcacagttagtgactctactgagtccaatgaagcaacaccctccaagaaacacaactcttgttatgagcgggtatgctcggccctagaagccaggggccacagctatgcccctgataactgacaaaatgttttccagctaagcagaaatatgtgatccacgtacagaagggaaaaaaatgtgccccaaatgataaactattcatttattaaaaggcaggagcgatgctggaattccagtgttttattaagatgttcatgaaatggacaaataggttagtcttgggtgtggtctttttgtcaaagtgtatccagaatgtcagaatttctagtagtaatatttaaatggttacttcatctgaaaggcagaggctaaaagtttttaaattagctgtgtggtgaggcagcataatacatcccactggttaagatgagagaggctagagttatatacagatcatttggatgggaattagttctacaaaaatcagctgaaatcatgaagacaaagagctgcttgacttcaaatgattgtgtgataagtaaacacagccttaatctctctttacattttacagtcctgacaactgtgtacacctagtctgcagtgaacggtctaaaggtgcaaaatatgtaacaaaaatacccaagtgtattcccagtttcccgagagatatgacctgaaacatgagactgtggactggactgggacaagaactaactaccactatcatagggctactgaacatggagagtcagtctttattaaaagacagttgcaacaattgcatgcgagggtttctgtataacagaatatatgatttttaaactatttcctgggttgcaaaagaacacatttagtaagaaacaacaatcttttcgcatctttttgaaatgcatatttgtgctgggtgtaaagaagattacaggaagggcattacaaatctggtcaaaacacctgtccatttccatcattgtactaacagaagtctgtactatttggtcagtttgtatggaagcataaatattccctaaattcctgcagttagtcttcatagaaagcaagctttctcaacatgccatctctgagatactgatgacgtttgccttactcacattccttctctttcctgtgtaaaatgcagatagatgaccaaatactctgggataaactgaatatgcctgtctttgtgctaaaatattccataaatcttaagggtgtccaaaagttctttattgtccttgtttgtaatcactttcttacttctacacaccatctgtatgcttctttatctgttactcttcctgattgaggactcttctgagccttttatagtcctatccatttcaaagcagaagctgtggaatggtattaaatattttttaaaattaattcacctgtttaaaagaaaacattgcatctcaaaaggtgaagatgattgttctttcttccatatcctccttacggcatgtccttggataacttttcaaaaggtatccacacttttggttgagtttagttttcttagaaagtagagaagtaacactttactagaataatgaacaaggaattgatttgctctaggcccagctctgccataaactcattgtgtattcctagacaggtctttaacttcatcagtgtgttgtttttgtgaagtgcaaaataaagatagtgatagtttctgctgtagccctcatagggacattgggaagcagtataagaaaaacttcagcaacatcatgattattgatgctaataggaaaaataaattcatgtaacccatagagaatccaggtcaattgtatttcctcttggaaagcagtttaacatgtaagcgttcaaagatgtgattcagataaaaatacccaggtccatagtgaaagatgtttttcagtatgttacttatggtttagctactagccagggaggtggtagcccagagaaggcaaaccacatacagatcacctggagttgattatatgagtctatgcttttgagctctttaggcaacacattctcattcctgtcattatcagttgaacctccatgccacacatttctaagaattaaatgcctagatggattaaatgtagtatgtgaatgttctatgtaaaagccaatagagtatacaagtgacttgaatgatttttcctaacttgtttgcaactgatagctcatattgaatgtttttatgtaaactttgtatcgttgggaagaattacccaatcagagatttatattttcataaatgttacatttagttaaattttgttacagagttgttacactagaaaattatttcagtcttcaaacaatatacagtcttgtgtatgtattatttgtatgaataaaagataaactacttaga

SEQ ID NO: 6062 - DNA, 2900 bp, Homo sapiens
gttctgcccagtggcctggcgcaggaaaggtgacccagtagttcagcctgtcccagctgcctgccccagcaccatcccagacccctttccctggggcccaccttggccctgaggaaggccagagctcggctgctgttctccaggaagtgcacacgcaggcggccccggctcgggggtggcagggcctcccctgagatgagctccagcagccgcaggaggtggatgccgtcagccagctctgtgtacaggttccggatcttgatgcccgcctggggaggggacaggggtaagtatggggtcagcccagcctcacctgtcctcccatcctgggacctgagaggtacgacccagagcagctgctttggaagaaggagctctggcctcagcttggcctcaggcagatgaccccacagctcaccccggaggcccactggccagagctgggggcctggtatgggtgggctgtgggtcacagctggctatactcacctggccgcactggaagacgttattgatccacttggtgaaagtcttctcctgcatctgcatgtgccgggcctgtagcttgcgaatgtggcccgtctcgtactgagagtccatggtgagacttggactgggcgggacccggagttctgtgctgggcctcctgctgcggtgccctgcagccccgaggagctcccggggactgtggggctgaccagccatcagccctgcagactttggggatgaggagctgctggatggctccctaaacctggagggcatgcagattaggggatgatgtgaatggagatggcccctctaccaggggcctggggtcccgccttgccagactgtcctcacatttcatgggggttgcagcttggagcccagccaggtaagggccagtgcttctggtcccctgtgcttgaatggcccagggccccctttgccccaccccaccttccagattcttcttctcagagcccctgctgccaggtccctccaccacagtgactgggacaggtggaaggaagacaggaaactgcttaccttggtgatgcctgggtcccacagagacggctctgctggacggatggagatggtagatagcaggggctgcttaccttggtgatgcctgggttccacagaggcggcccagctggacggatggagatggcagatagcaggggctgtggagggagggagagggacatcaggagaggccaaggctggagcagggctgcaccacagccctccccttgagccagcgtgctggggtgacggcacacaggcggcattgtcctcccacctgccacagggcgtggcccagacagggagggggtggttcaggaatgctccagggccattgccagatgatgtcctccttcatcatcctcccttccccgccagcaacttctccaactccaggtgggggtcctggctcccaggacgcagaggcccatggagcggccctgccaccgcatggggtgctgcagtctgcgtaggaggtaccaaagggcagagcctctgtgggaagcctgtggacgcacttcccaatctgagactgccctctgtaccctcttggggcctctctgtgagcacccagggcgaggggatgagggagcgtcctgggccgtggtcttctcattcacccccagggaacagcccatagactgagggcctcacagaccctgggcttggctttccaggccctgccagagtgcagcctgcctagcccggggctgaagggtaggctccctggaggaaggggtgacctggaactgcgagggctgtggagtctcctccaaaattagagacacggtgttaactctgggctccacagagctggccgtggcccggggctcggaggcaggggtgcagagggagctggtgggcgcccatcccttcctccccgagcagccgtggactacatgccagagtgaaggcgagttctaattctgggggtctcacccgcctctggctaaactcagggtagcagtgtgggctggggtgtgtgtgtgtgggtgtcttccagcggccctggagcctctgaagcgacagcccgctcctcagggaggcgctcctggcagccacagcccacagcaggacagccgctcagcgcgcccttgagagctgggctagggatgagtcacacttgaaccgcctgggcccactgcaggcagtcaggggtgacgctgagaggtgccgtggtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactgg

SEQ ID NO: 6063 - DNA, 1968 bp, Homo sapiens
gaaggctccaatcacaaaggatgcccggttccacactcaagtctaatgccttactaagctagtacgtttggacctcagaacacccctgagacgccggtgagaatgtcctcatttcacaaatgaggacaggggaccagagagtctttaaggaaaaaagaaagagaaatctagttaggaagtggtggagctgaggctggaagccaggactctgataccggcccgcgcaccgccccaccccgcatcctggctccagaactccccgctgggacgcgtctctcctgctgcacctagcacagctctatgactcacgggtgttagggcaccgtgcttagggcagtgacaggactgtcagcagcctgagagtatggccgctaagtcaactcaggactccctaccccgagacacaggggagccctcagcactgcctgtacaagggagggcggagggaaggagcagtgaaggacggaaggaacgcactgctgagtgtgctctgcgtggcaagcaggcttcagagcctgctcttcgcaagaggaactttctgcctggcccaaacagtgacactgtgaggcctgctgcagagactgagctggtgccctgcagcctcagacacccacggcaggacctgtgtggagagcacccatccttcccagtcatgcagcctagcctagagacacaagcaaagccagaacgagacagggcagtgctcataccccccaaaggaccatggccccctgcacagggtctagccatgaggacccactgcccaacaggtcctccttcaaaagcgtattgcagaggcggcagcagctccaccagcaggaatcaggttgccagcttagcctatcgaacacaaaacactgctgcttcccagccacgtcaaccaggaggaagagggaaagaggatacagctggatatggaagctgcagccccagaagtttggctgtgtgactctgagcactgtatttggcctctgcctcagtgactttctcatctgtacaatggaccagtaatgcctgtaccttctgggttgctgtaaagcccaggataacttcagagaggcatctcgcataatgacggctgctttaccatctaatgagtactaatcattaccttaaatgtttaagaggcaggtcttgctctgttgcccaggctggggtacagtgtcatgatcactgctcaatgcagcctcgaactcctgggctcaagcaatcctcctgcctcattctcccaagaagctgagtccacagacatgtgccaccatgaccagctaatttttatttactttattaatctgtttattttgagatagagtctcactctgttgcccaggctggagtgcagtggcacgatctcggctcattgcaacctccgcctcctgggttcaagcgattcgcctgcctccaagcgattctcctgcctcagcctcctgagtagctgggattacaggcacccaccaccatacccagctaattgttttctgtatgtttagtagagatgggtttcactatgttggccaggctggtctcaaactcttgacctcaggtgatctacccacctcagcctcccacagtgctgagattacagacatgagccaccatgcccggccccgtaatcattacttaccaccaagaatgcctctcattccacactcatgaaccacatttgtctatcagttttaagtgttatgatggttaccctgcttgttattaaagcctgccaataacagagctgaaatatcgcagccaaaggcagagacacgtgctattccagaaagacccaactgctctgcatctgtgtcagcctccattactctggttcacaatgtttctctctcacccgcatcttctatttgtacctcctggtcccccagattgggacccatgggactatttaatccaaaattttattgaaacattgttgccgcaaattaagttttttaaaaatgacaatagttaaattaaactggt

SEQ ID NO: 6064 - DNA, 3074 bp, Homo sapiens
agtgacgctccggagccgtcgccagggtggtaatacctggtgcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttggttactactgaatgcccacagaaaggaagaaacttctctctccctttagacaaagtcgaattcttatcgcagctcataaaatcctttatgaaactggaaaaaggtgttcaagaattgtttgacgaaatacttttatcactcaagataaccagggatacttcaggaattttggagaaatccgatagagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacgtacctttcaagaacaagtttccgacacagaaaataacctgaaccaaggacccagcttgatggaagccatctttaaaatattgtaccattgcagtttttctccacaaacatttgcaaacgtttttgtgagctacatggaagaagagcaattatgggactttttatataacatcccaggtatgagacatttactgtttgtaaaagaaatgttctatagatacttatatgtacctttaaagatgtttagaagttgtattgatactggttttgctgaatctgttgttggtgaaagtttaccttacattttttcagtataa

SEQ ID NO: 6065 - DNA, 1630 bp, Homo sapiens
acaggctcccgggccacgagaaaccggccgagcagtccgggccaagctccccggaaccctcggccgtcgcaacccccgacgccagggctgaagcgccgggcactgccgcctccctcggtcgcccgcccgcacgcccggagcggggaagcacgccgcctccctacgcaccagcatggcacctcgcacaagtagcgccgccaaagtttccccacgagggggctgagggacaaaagcccctcccgaaactcgcccgaacttcgagggcctccgacctgcacggccctacgcccaggcggcggccccgagcgccgggggcccgcacgggcacatgcagccctttgttttctgtccagccgggcgctgcctacgtgcagcatcagggatgtcggagcgtttcgcaggggccggacactggacgatcaccctgggtaggggtccggaccccgcgccccgaagagtccggagcctggccccccgaccctcccctcgggagcaggcccatttaatcaaagttttgcagtgtccttgatgagaaacgcccggagtatccgccccgcacgggcggagagttggcgactttcactctgctttttaaactggcaagacgccatcatcagcaaaccacattgtcctgccggccggacctgcccgacggcggccgcatcccacggctcacgcggggctggacattcggacaaggaccagggtcgcagcccgaagcacgtggtctgtcacgtagagcacaaaaagcagtgccctgcggagttcactgactcccgcggcgtacacaacgccgccgcctccatctccagccaagttggcttccctggccatcttacagcgcggacggccgcccataaacgggaagccctcgcggtgtcgcccacacctacgctacaggtgaacgcaccgggagcaaaacttcgggctccgaaagcaccccggacaccagaggctcttgggcgcggtccgaagagggcaggcgagtggaagacgggctgtttttaagcgaccgcgtgttgctctcattgtcgcatccgcatccctccggagttgagcaaacaacgccacgccgcgtgcgctccggcagagcccagcactgacccccaaaggccgatttaaagaccctcggccgccagctcggaagcggatggcaacttagtttccgagcgaatggcgtttattgtccaccctagtccgagggctgcagtcaactaaaccacgaggtttcacaacggcgcccgaccctgcccgcgcctcgcgcccacgcggacgcaccgaccccggccgctgcgcggtggccaacgagtcgctttcctctcgggcctttcggccgccgggctcctttccgcgagagaacactgcggcggagaaaagtcattgtcaccttcaacgtggatccctcaactccggcgactcctcaattatgcccaggctccactcacttccccgccccgagactttcggtttgcctcaaataccctccccaattaataaatacacactaaacacgagcgtaccaaagaacctggggtctgaagatcacgaaaacagcgctcccaacaatgccacctccaagacaaaacttcctgtgtgtatgtggaaggacggggggaggtgggtggaggtg

SEQ ID NO: 6066 - DNA, 6312 bp, Homo sapiens
ttgacaaggcactgctttttcatgacgcaaaacgtcatattatttcacaaaaagcccagcgatttcacctgaagaagcttgggaactcctgccaaaaattgtagcacttctcacattgcaatgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgt

SEQ ID NO: 6067 - DNA, 1898 bp, Homo sapiens
aagtgtggcaggaggaaggctgtatgatataaaggaagaaagcatgcatctggaactcagaacttgacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctg

SEQ ID NO: 6068 - DNA, 3266 bp, Homo sapiens
cacaggcaggccgtacctcgaaatcccagcggggacacctgtcagggagacgcaccctcacaccgcccatgcatgcccgacgcatctttgggatccttagggatcacgtggtgcttccttgaatctccgcttgaggtttcttcaggcaggttcggccttgcccgactcctaggatcgcaggaccatggcgacgatcccgcggagaggggacgcactgccacagacgcctgggggccaagccgctggggccagtcccccggcaacggtggcggttactgtgacgcgagtcccccctcagcgctagcgcctggtgatcgcgcctgggctcttcctgcgtctccaagctcaggggctcctgcttctcagcactgctgtctggaaaaggcgggaacgaggactaaggcaagcccagtgtggggcagagatggcaacacctggaactagcttttcatgggggcagataatgtggagagtgtcccaattacatctccctttattctatcccatactactaaaccccaccagctatttgcctacaaactgtgtatcagtcaggacatcaggacaccaagataaaggactagagtttggtaatcaactactggctcctccagcagctcagaatgtggcctgtatgcatcacttcacttaattcattcaagaaatgctgactgagttcctgctgtgtgttggacactttcttagaagtgggacacactgcagtgtgtgggacaaaggctgggccgctcattgcttatgttctagttgaagagagagtcaatcaacaacattctactttcagacattgataaatgctgtcatgaaaagacaaggaacatgaaaaggtaagaaaagggatggagagagatgggatgaggggtgcctgggcagacaatgcaatgatctggcaaaagagtaggacaatcatgagactgcatgtgttccagtttctgctgctgtaaaacagcatccacaggttacatctttactattctgttacatacatactattatttaaataaaaaatagtactagttaactgtgaaaattgcaattaatagggcagattaaacaaatcctttaaatttaaacaaatgttttatggttttttatcctctgatacattgtttcaactttaaaaaaccctctttatttgatatttaaactctatattaatgtatattcttaagatacataaatttaagatttttttcgagacagggtctcattctgtcacacagtctggagtgctgtggtgcaattatggttcactgcagactccacctctccaggctcagataatcctcctgcctcagactcctgagtatctgggaccacaggtgtgcatcaccacacccagctaatttcttgtatttttttgttgggatggggttttgcgatgttgcccaggctggtctcaaactcctgggctcaagtgatctgcctgccttggtgtctcaaagtgttgggatcacaggcgtgagccaccacatccagcctaatttaagatttttaaaaagcagaatgtaaatatggtcatgcattgtgtaattctgtggatactttctgagtaatgcatggttaggtgacttcatcattatgtgaacattatagagtgtacatacacaaacctagatgatgtagcctgatggtacagcctatcacttcgaggctacaaatccaaattgcctggatactgtaaacaattatactcaatggtatttgtgtatctaaacatgtctaaacatagaaagggtacagtaaaaatatggtataaaagataagaaatcgtataccggtatacagcacttaccgtggatggagcttgcaagactggaagttactccgggtgagtcagtgactgagcggtgagtgaatgtgaaggctagggcagtactgtatactactgtagactttatatgtactgtatgcttaggctacactaaatttatttgaatttttttgtcggtaataaattaaccttagcttactataatttctttataaaccttttaatttttaaaaatgttttgactctcttgtaataaattagcttcaaacacattgtatagctgtacacaaatattttctttatatccttattctataatcttctacttaaaaatttttttaatttttttattttaatttaattttattttattttgagacagagtctcactctctcgcccaggctggagtgcagtggcgtgatcttaactcactgcaacctccgcttcccaggtaatattatttaaataaaaatagtactagttaactgtgaaaattgcaattaatagggcagatcaagcaattctcttgcctcagcctccagacttttttgttaaaaactaagacacaaacacattagcctaggtacacacagtgccaggatcatcaaaatgtcattaggcagtataaacttttcagctccataaaagttggaaaaaaaataataataataaatacaattttataaaaagaaaattttcagctctgctataatcttatgggaccactactgtatatgtggtccctcattgaccaaaacatcattatgtggcacatgattataacaaatgatggatggcgaggttgtgaagaaactggaacccttgtgcattactggttgtaatataaaaaggtacagccactgtaaaaaaaaaacacagtttggttatttcttcataagttaatcatagaattaccatataatccagcaatttcacttctaggtatatgcccaaaataattgaataaggtgtttaaacataaacttgtacaagaatgttcatagcagtacatttcacaatactcagataatcctctcattggaagcaactcaaatgtccaccaactgatggtattacccatgcaatggaatattattcagtcataaaaaggaatgaagtactgaggcatgttacaacatgaaggaactttgaggacagtttgttaatacgctatatactgtgtaattctatttatatgaaatatccagaataggtaaatcattagagactagagacagcagattagtggatgccaggagtttggggaaggaaggggtgggaagaatgggaagtgactgcttaatggatacagggtttctttttggggtgatgaaaaatttctggaactagattgtagtgatggttgcacaacaccgtaagtgtaataatgtcactgaattatacactttaaagtgatttaaatggtaaattgtattatttatgtattttaccacaataaagaagtcacctatc

SEQ ID NO: 6069 - DNA, 4241 bp, Homo sapiens
agtttcctagcaaccggcggagcggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaag

SEQ ID NO: 6070 - DNA, 66 bp, Homo sapiens
ccgtcctccacccagtaccatgtcctagcctgtctgcatttgttagtggtcccttgtctggcttgg

SEQ ID NO: 6071 - DNA, 5141 bp, Homo sapiens
atgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggcagggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcggc

SEQ ID NO: 6072 - DNA, 1937 bp, Homo sapiens
acgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatata

SEQ ID NO: 6073 - DNA, 2875 bp, Homo sapiens
catgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaatgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatccc

SEQ ID NO: 6074 - DNA, 2122 bp, Homo sapiens
aaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggctctctctctgctgcccaggctggagtgcagtggcgtgatcatggctcactgtagcctcgacctcctgggctcaagcgttcctcccacctcagcctcccaagtagctgggactccaggtgtgcacaccacacacagctagtttttttattttttgtagagataggctggtctcaaactcttgacctcaagtcatcctcccgcctcagcttcccaaagtgctgggattacaggcgtgagccaccacgcccggtcctgattgaggaatttaaaagactactctggttgatttggagaatggatcagggggcagagggagccccgagagaggaggctcaaggcatagaacagcctaagaacagcctcgctgaagatggtggtggcctggatgagggtgtcagtgctcttggggtgcactttaggtgggctcaactcatcctatgaccatttgcattttcagcaatgcctttttctggaaagaagttttcaaatgaatgcaaaagtgaagagattagttcagtaatgaggcgtgtatccatcacctgcttcaataattacaaacattctgctattgttgtttcacgtatccccttaacatttgaaagtaaattgtagctatcacactatttcactcataaatccttcagtatacatctctaac

SEQ ID NO: 6075 - DNA, 609 bp, Homo sapiens
aaaccctatgcgtgtaatgaatgtgtgaaatccttttgtgtgaagtcaagtctcattatacaccagagaactcacactggagagaaaccttacaaatgtaatgagtatggaaaaacttttcaccataaatcaaccctaacagtacatcagagaactcatggggagaagccttataaatgtaatgaatgtagaaaatctttctatatgaagtcacaccttgctaaacatcatcgaaaatacaccaagaaaccctatgaatgtaagcaatgtggaaaaaccttccagaagtcacacctcattgaacatcagaggacacacccaggggagataccccatgaatgtaataaatgtgggaaatccttctgttataagtcacccttgaccattcaccagagaactcacatagaagagaagccctataaatgtagcaaatctgttacttatttctgtatgaaatcacacctcactgtgcatcagagaccccataccaggaagaacccttttgagtgtaatgaatgcaggaaaatgttttatgtgaagtcaaacctcatcaatcatcagagaactcacacaggggagaaaccatatgaaggcaatacatgtgggaaa

SEQ ID NO: 6076 - DNA, 2228 bp, Homo sapiens
gcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttgggttagtgacatttaaaatttttgtttggtttaacttaagtcttttaatatgtttaattttctaagatgttttctatttggttaaatctcactgcaaacatgaaaattagaaaatgaatgtaatgaaattttgcagtatacatttctcatgcatttttttctataattgtagttataaaagtattttctttcttattaaattgttaaagatattggaaatataagccaaaaatactttaaataagagtttaatttctcttgattgcatatgacaaacagtatttgtgaaactgtgtgtatacacacatatatataaatgagtatatatgcttatacacatataagctcctttatctgtttattaaatatacgcatatatataagcacatatactcagttatatatatgtacatttagttatatacataacagaaaagtatgatttttaatccattgtatcttccaaagctaaagcattattaggtaaaaagaatttttgaaaatttgttgaaatttgcagtaaaattggatatttaaaagttgtaatattttagtcagtcaattctaataatgagcaactatgaaatactataattataaaattctgtattgtagttgattaggaaggtataacattttactatagctatttttaaagtttctctactattttttctataaggatgtatacaaataaaagatgatttgaaaatttctattttattcataagataaaggaaaaaaggaaagaagttattgtgatataataaacttttcttattgtggttgtactttcctaccagtggagaaaaatcagggtaaaaataggattatttctaaaattatcattagttatgcttttatataaaatctgaggtgtatttctgaataagttcataaactatatggcttaagtatttgaaaattattatttggtgaattatggatctttgaatttatgatcatctttttaaaattcctatagctcactatacttgtgcgtatcttcattaataaaatttcagttgaccaaattaatgtga

SEQ ID NO: 6077 - DNA, 2906 bp, Homo sapiens
ccagcccgcagagcacggtcctgggggtgtgatcacagctgctgaccgcggctcccgccgtgtgatgtgaccactcggaggtggggcgagggggccgggggccagcagcagggagtgtgtaaaaggtcttcttcctcacaatacgattgaaggtgtttgggacgtagggctcagatccaggagtgccgtcctccaagccttccataggattttgtgacgcccttgagaaccgcccttgtagactcagtcctgaactaccgccacgcctgtatttgctcctcctcatctcggattattgctttctttacttcctctgtgaagcactaaatactagtagctttttaagaacagaccacaacagtttcttcgtttgaccattactaagtctgcctccaaaatggggagttccgttaactttatcagccagccctgccaattttagttaagataagccttcgtgggcctccaaaggcctctgagagactaggtacccagagacctctgaggtatgttaaatggtttagttcgtggtggtgcaatgaaaacttaaagaaggaaaggaatctgcaatttgaactgttaacagaccccacatttacacactgcctatttgaataagaatctctttcagtattaaatgttttgtgacacacaaatgaatttgtacacagtcttttagcttgaatttgtagacagcctttaaatgttgtttggggatctttggactaattgtataagcgctcagtctggtctcaaactcatgatctcaggttatccatgcgcctcggcctccgaaaatgctgcgattataggcgtgagccaccactcccagccccttcttgtgatgatgtgagatgataaaatgcctgtgtgaagatgaagtgaggcgaataacctaggcagtgtgacataagtggaaaacgccagaaataaacaattcatgttataaattgtgcaccattctgagtagtgtgatgaaatcttgcactcctccattccatcctgccagcattgccagtcactcggtggccatctctgtgatcagattaacagtggttttatcagtatcatagggcttatgttcaagtaactgtattttacttaataatggctacaaagtgcaaaagtagcgatataatatttttggaccatggttgactgcaggtaactgaaattttagttacatgaaaccacagataaggggggactgcactacacataaaataggcataagtaacctcaagacaatagacattattaaaatatagaaaagtaataaagaagtgataaatggagaacttttgctttaatataatttattgtaagtttatataatttaatttttagtaacttcaatttttaatattttaatttttaatgatttatgtgtttaacaactgactcacaaaattgctgaaaatttcccaatcttgatgaaaatttcccagtctgctctcaggagcctatatgagccagcccagaataccactggagttataattttagaagattaccttggtagcaatctgtagaaatgttttgtaggggagctacagtagggatcaaaagtggagacagattacgaaatgtcttcagaccctgccagcatgagggttcaaatgatgtctagtcagtggagatcacgcaaatttcactggtttgtgttcccacgtggatccgtaggaccttcaatgcaagtctccttcaggtattcctggtggtatcttggcattgtctcacatgtgttttgagagccccacttccttggggagtcttccgctttggcttccttgttgatgaccgtgggccaaagggctttgtgtgtgaggctccacctcagccatagctggtgtcctcctgaagaggatttatgccaaaaggagtcacatgccaggacttgtttttttcaagtttgcaaatctggggggagggtggggctctagaaagatgctggaacctggtatgtgccctgcagaaatgtccttgactccttttgtcaccaggagcctaaatttactgtgtttctctgtgactcacagaggcagggggaaagacaatcctctccacttcttcctgcagctacttgctccatcagcctcagccagtctggggctgggcagggaaacaggccctcttccttctcctggtttgtcccctggtttgctcagcgagaccttcgtgtctgagggcccccttctcaccttgcagatcagctggtgtggtactgaatgcctgatggatggccaggggcccctgatccatctgcattcccagaatataagaatctcatttggggccacccagcccccactactcttagtatatgaaataaggtggaatagataagaggatggaactggcccctgggtgcatgatggggccaataacggaggtacagggtgcatatgtggctgggctgtgagacagggaaagaggatggaattgagatgcaaggtagaaaagcatgactatgttcagtttgggacttgatgaaatagatactggtaggacagttcactaggcactgggccttcaggagaaagagaagaaaggaatggtggcattgggagtagtaaagctgtgggtatgaatgagtatctatgagactcacctccctgtgaggacatagaatgaggagacacagtctacaggtagactaggtcgagttcagaagcctgaagaacaccagtgtttaagggatggtgttgggaaagggagccaggccagccagagaggaatgttccggaactctgaaaggaaggaaatggcaggaacaaaggagctggggcacaacagtggtgactcacactgggaacacttcggcccattgtgtttatgcttatagtttcccaagtttatcttttcagggttatgattacgttaacctcacctccctccctccctct

SEQ ID NO: 6078 - DNA, 2137 bp, Homo sapiens
aatagacacaaggagaggcaagaagctccacctcaccccagtgggggctgcaggtggatggagaccagagcatgcggagcgcccctgagcagccgtggctggggtgggagcagggccatgatggctctggagaaaagtggggcaggcagctgcctccctggggctgaggggctgcaaggagaagttgcatcccgatgcatggcctatgcatggtacccagtccccatggccaccctggcatttcaggcacctgctgtgcaccaggtcaggccccagaccggcatcctctctctctctgtgcacccacacctggcaggaagcggcagcaccatctggttgcctggcagccttgtcctgctcccagctgcctgtggccccactggactcagccccccagcagggaggccttcggctgcagggcaggggctgggcgggcgcaccctgtggctgggggcactcaggagccctggcttcacctctgctctcggcgcacatgtggacagctcacccttcagcaggggtccggaccaaagtccttgacccaccgggttctgagtcctgacagggctgtggacagcttccctttccaccccggcacgtgctggcaggagcttccgggccctcaccctggggcagcaactcctgcaccaccagccacgcccggccacgagaaagtgcagaacagctcaggcccttctcacaacttcctggagctcagggacagttttttgagcacaaatggtgttaggtgacagactcgggattggccttggacactcagccccctctttctggagcaaagactcatgacccacgtccaagtcaccctgcacatccctaagcctgaccgtgaagcagccctcacggatgcccaggactccctgtccgcaccaccaggcagccgaggcaggtttggaccagcttctcacactcacaccttcctagggttgccccaggccctgacctgctgaccctgcagctatgacctctgacctgtggaggatgggaggggtgagcagcagggagagtgggaaggaggaatggaaaaccgtccaggaagggaggctgcagccccgacacgaacaggagccaccaccagggggtgctgtgcagggctcccggaggacaggaccttccagggcctccctgccccgaacccataggtgccaggcttctcactgctcacgacctccgtgccgggctcatacctgccgcgccagcccctcttcagcagagcacaagtctggcagcaggagggcaccagccaggggccccgcgcccccgcctctgtacagcagggtcaccgtggggtgacatgagaacaccgacccagggaatgggctcctgccacacctgcctgggaacctgggctgtgagtcctgctcgctgcaccctctagcctgacgttgaagtaacctcgccagcggggccctctgtggcactgggcactcagggagagcacgtggcattggagaaggtcccacccccaaatgcaaagctgggaaaaccaggctgagccggggatcaggccacctccgcagggacccactgctgcctcttccaggagcccaggagacccagtgggtctcctgcccccgactccaactccctcctggcaggacacacccagctcacagtggcctttccatcctgggaaagggagtgagaggaggctcaggccagggacccgcccagctctggccggcaaccgcccttcagcctttcctgaaccactgtgtgggccccaacccatccgctgcctgccggagggagcccatggggaatggactattcttgccacccctatccatggcaggggaggggctcagcatggctcttgcccacccagaagaaggtgcagggggcctggcgtggtggttcacacctttgggaggccgaggtgggtggatcacctcaggtcaggagtttgagaccagcctggccaacatggtgaaaccctgtttctactgaaaatacaaaaattagccaggcgtggtgatgggcacctgtaatctcagctactcaggaggctgaggcaggagaatcactttcacttaaacccaggaggcggaggttgcagtgagttgagatcgcgccactgcactccagcctgggcaacagaacaagactccgtctc

SEQ ID NO: 6079 - DNA, 4436 bp, Homo sapiens
gaacgatcgatgctttcttccgcgccccgagagccgccatttttgagagcgggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaa

SEQ ID NO: 6080 - DNA, 6224 bp, Homo sapiens
ctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaaaaaaaaaaaaaaaaaaaaaaaaaaaaagatacattggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtcttcctctaa

SEQ ID NO: 6081 - DNA, 11775 bp, Homo sapiens
tccgagccgggcgcgcggagctcggggcgcacggagcggcgcgcggcggtcggccgagccaggctggcgcccccgccccccgccccgctcctcggtccgccgcccgccgggcgccttccccgctccacttacctttggtgcccggccctctggccgctctcctcccgccctcgcgccccttcggcccgtcccgtccagcccgggctgcccggctctcgcaggcccccccgcgccgaccgcgttcctatggacagacgcacagacacctgcaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagcttattccactaagctcaacaaatttcctgtatttaatattaatgatgacttgaatgatctgtgtaccagtgcagtaagcccaaatactaccaaagccacgcggtacgccttgaatgtgtggcgttattggtgcatgaccaacgggctcaaagaccacacagacatcaccaagatccctgcagtgaagttgaacgagctgctcgagaacttttatgtcaccgtcaagaagagcgacggctcggacttcctggccacctcgctccatgctattcgccgaggcctggaccgcatcctgaagaatgcaggtgtcggcttttccatcaccagcagcaccttcagctcctccaccaagaaactcaaggagaagctgtgggtgctgagtaaggcaggcatgtcgggcgcgcgttctcgcaacatcgtctacttctccctttctgacgaggaggagatgtggcaggcagggtgtctgggggatgacagccctatcactctcctgtccactgtggtcaagtacaacagccagtacctgaacatgcggacgctgcaggagcatgcggatctgatgtatggtgacatcgagctgctcaaagacccccaaaaccagccctactttgcccggacggacagcgtcaagcgggagagtcggagcggctccaccagagtgtgtcacgggaagatctaccatgagcattcccggggacacaaacagtgcccttactgcctcctctacaagtacatgtacatccaccggccgcccacccaaatggaggccaagtcccccttctacctgactgccaggaaggaggccacagacatgggcagcgtgtggtatgaggagcagaggatggggctgcgctctcttcggggaattgtcccaaacttagccaagaaggtcaagctggaaaactgtgagaacttcacctttgtctcgttcactcaggtctcccggaggcttggctcccacagctgctgccagtgagcccccactggggcccggccactgccctgtcacctgctcgggccagccagggttggagcagctggagctccttggaggcaggggctgaccaggtgtgacctcccggtctggcggctctcccctggtgtggcctgccctccctttgacttggggtttgctttttaaaatgaaactagatgagtctaaatcattcggatggtttatccaaatgtgcgtcaacttcgttagcttttagaatctaacacaatgtataattgttacatacaagagtgaggaaattcattttctctagtgcctttctagcacaggttttctcaaaacaaacaaacaaaaaaggaaactgttaagtagtcgtttaaaaaaaaaatcccagtagcgcagtagctttagaacgttaggaagactgtacactttgttgaattacactcacaattagaaactagagagaggcagacacgttccctatttccaggagacagattgcgcttgatgcgccttttttttctgttggtggataaggtggttctggagggcaggcagccttgtgtcggggagtatcctcaagcgacacttggtcatctgacaaggacttgggctgctcccacggctcccagcagcggtaggaaccccatctcggctgtcaatggagagaattttatgataaaagattcacgcaccagaagggtgtctgtgagaacaaggcttctagtgaactagacagtttgtaccatgagggaatttctagtagtgaaggaaaatggcttggaaaagccaatctgtgatcaaaatgtgaaaacctcctgaagcagaagtgcctatgttttatttctcagcaccatgtgagagctcctttgattggaacattttttgaggtttctgtctgttcttcgtgtcatcccattattcggtcagcatataccactggatctataaaacaactaaaggtaatttttagtcttagccaagaaaagctaaccaaacaagctgcaaaaaacacagatccccaaactttctttattaaagagatttggaatatttttgtcaatgtatgacttttcagccacaattacatgtcatcattttaggatggcaccaatacttgggacacgatgatttaggcaccccaccaggtaagcaaactcagcattaaggatgtagttataaaattagcgcataatggtaggtaatgcagtttgaaaccatttcactcaggtaaaatgcaacctgaccacattatttaaaaatcagcagaattttctaataactactctgagtgcaacaacaagtgaaaaaggagctcaaagagtgctcattaagagtaacaataatttctagggaccttgactttgcatttgaggaaaatcttgtgtaactttattccattatgctcctaatatgctttctaatcccaaattaaaactctaatacaaattcattttgtagaagtcttaaaatcagtcctctttctttttgaaaacattattttagtatttattttaattaattggtttcttaaaaaatcatacactagtcattgacatatgtaatacttcctttaccagagaagactcaaccaatgctgccttaagatttaatgttattccctttttagtcactgtgcatttataagtttgtttactagttgacctttcctgaatagagattagtttcggcatttctccatctgtatataaataacaggtaatatttaatcatcagtgtatgacttgatatcacataacgttctggtgtggtttcctgtagtgatcttagggttttgatttaaaagaaatacacaaaacattaggtacaatttcctttagtttgctaaacacccaaaggatattttgttttgttggttctgcacttaaactgaaatacaacctatgtgaactattgggcaaagcctgcagcctaattaattaaaacctccatttttatttgaatagattcaagtagaaattgccgttaggaatcactgggatcttttcggattttgaccttttcaaaggtagcaataactactccagaggttgtaatctttctgttggtagtggcttttcatcagctaaataatcatctctgcctcaaatgtgttgcctgtcacctagttgatgttccataaaatccctgggttctgaagtgaattattataattaataatcaggagggcgaatcttcagtggcatctgatggaatgaaagaactgtgtctgagcagcctaaaagctgtttgtgacatgccaccttgggaaacaagagtgaggaagaaaacacagtcatcaagtgccagcgtgtgccacccattgtactaggtactttattatgcatttatgtatatgtgtgtgtgtctgtgtatacacacaaacacatatacataagtgtttacacacacacacgcacaatatgtggttaagcctggtaagcctgctaaaatggcaaagcggcctggcgcgtggctcacgcctataatcccagcactttgggaggccaaggtgggcagatcacttgaggtcaggagttcaagatcaggaccaacatggtgaaaccccatctctactaaaaatacaaaaattagccgggcgtggtggcaggtgcctgtaatcccagctacttgagagtctgaagcaggagaattgcttgaacctgggaggcggaggttgcagtgagccgagaccatgccactgcactccagcctgggcaacaaagctagactccatctcaaaaaaaataaaaaataaaatggcgaagcacctgtccatgtgtttggccaaagccgtcctccgaggtcttaagggggccagagtagcagtcctcgttggcgttctaaggcagttgttctggcttccagtcagctctaaaccttaccttctggggactccaggattttctgctcttggcctaatgcaagagaaaggagaatccccagagaaagaagtggggaggtaaagagcgttttctccacttacctttgggttttttatgctcccaagtagaaataaatatcaagaattcacaggttgactgaagcacaagttgcccctgggctctgtgtcaaggctggtggtactgtaggtgttatgagaggacccatagggtgtccttcaggtgagctgttgtccacagcacctttcatatctgctgtaaagggagccctactttctgtctatcccccccaccgccggcccccggaatctaagcagactccctgttggaagcttactctggcacagaagctaggatgtcaccttaaagggtgtgattcaattgaatatagtttagtgcggtaccaggcacatcataagcatgcaataaatgttagccagcttagttataacttttggtaataattaatattatttaactaatttgcattataccacttatttcttccattatggagattctgtctcccttaaactgttaaacttgaagaagaaaccaaacatgataatctggtcaagttaacacattttcgcccatgaattctacctccaacacagccaagctctgatacctcagatataagcaaaaacaagtgaaggaagaacagaaaagccttatggggctttatgagaaggtttttccattgtttagtgtgtttgcaaaaaggaattttatggaagtacctaaccaaagctgtgacagaagggtctccttggtcatgtggcattttccagctttccttggattttatgctacattaatttgccctggctgataaatggtgtttgaagaaatgtgaaattttgttactttgatttttattttaattcaagcttattaaaagcatcaagcattatatgccacactcagcattttcatagacatagtcattaggagaatctggacaaagtaatactcttgtagaaacggaagcatcttgctgtacttgaaagataactggactcagagctacttcactcctcacttgggcaaatgccgatatcactttgcttagctataaagtgccatcagtgggatggatcgtcttcacggtgaaccgtgttacacttctgcaattcctcaagttcatattaattaggaagtggcagagctaggacacaaaattcctaattcctgaagatagttagtctcctaattaagtgcttctcactatattgggatgccttctttaggaataagactttcctttaattttcaagttccacaacttctaaaattattttgctatctcgaagcagcagaatattgatcatttttctcagtttaggctaacacagtccacaccattaccacttaaataaagtaaccgaatgctaaatattatccttatcaaacatccatcactttgttgcttttatgagatgtagattgctaaaaacttttgagctagtagacgttacctttaagcatcaatgaatgcaaacagtgaagacctcaaagaagagttacctcattttctctacatgatctccaatgtagtctcagataaggcccatacatagttaaaagctggtaacagctctgaacagaagtatgtattaaatgtttcaaacttgtatatatttttgaatgcttttgtttttggagtgaatttttaatactctgtgttaaaagaaaaacattccatcttgtaggcagtgttcctcagtaaaaatctttgttgcattttcccatataaatgaatcacccttattaaaacaggaggagggagggatttgtggtgacctaccgctgccctccctttctaagagaagaggaggccatggggtatgataactaaatgaacatctctggaagttcctccgtctgatatgtgtattctgacataacagaatttcccaagacttctttgaggaaggctgtccacgcttcaggcaaagtttacccattattattatgattttgaatattccttgttcattacagtccagaaaatctgcagaagttctccatgttcagtggttgaccagaatctgattgttgcgctcaattaaagtgcttattatttagctaaaacaacttatatggaagttaattatttcaggaaatacataataagaccaaaaaaatcactggataatatgtagatatattttagttccattactattaatagcaattagataactctccctccccccattgaggtgagaatgggctcctagatacttggtggtcaatagaactgatttgattaactttcatttaactgtggttattgttacatctactgattttttcaaataaaaatttctagaaggctcagatttgactaagactgtgttacgtgctttctcacagctgccatatattctcatgtaatctttacaaccgctctacaaggtatgtctaattatttccattttacttattgagaatctaggctcagaggagttaaaattctgaaaatctcaccgataagttggagaatttaagtttgtaagttggagaatgcaggttttctgactccaaatctagtgctcagtccatgagacaaaactgcctcctggaggccatggaagtccattaactttaagaaagttaaacacagttttggtttgtttggcaaatatttcatctctcaagccatactgtgtcacccctccatgtattctcttactaaatgattgctcacttgggaacttaatcgatcctggaaagcctggcggttccccagtattttctgcctactgggaaccttctgtctttatccaataagtaatttatattacctgtcatctaccttaaagggcagatggtcatgtgaatttattctaatgaaagttagtttacaagctgcacctgttttgacattggactcactgcttaaaaagtaaaggagttcctaacttacgcaacaattacatgctcaggttttttacttttgccatttaattttggtcagaggatttttataatctgtaggctatagcactgtcatagaaaaatatacctttttttttttttgagactcaggagtctcactctgttgcccaggctggagtgcagtggtgcaatctctgcctcctgggttcaagccatcctcctgcctcagtctcccaagtagctgggattacaagcgtgtgccaccacgctcggctaatttttgtatttttagtggagatggggtttcatcatgttggccaggctggtctcgaactccgacctcagtgatccacctgcctcggcctcccaaagtggaaaaatatacttatttactcgttttctgttcttttttcctttatcggggcatatttattttctctttggagacttacaaagcaataggttatatgaaactctgagatcatctagtcaaattcccccattttatcaataaggaaatttaaggccagagatattaaagggcccatccaagatcagccaaacaataagtaatagattcaggactagagagttagtccagaactctctcctccatatcacagctgagaagatttagatttttttaaattaatagagctgcatctggcaaaatgacatccggctcacagaagaccctagtgagcttcttgtaccttcccagaaaaacccagaagaaggccaaatctcaattctagaatctagaaggaattgatgtaatttatgaggcatatggaggtagcttggggcaaaagtttccaagtagctcaattcctggcttacttcatgaaacaggccctgtgaaattaaaaacatgaaagctatttagtacttgtcctcttccccaatcatgcctgtcaccttactcggagtcagagctcctgagccagagaaatactagctgatgcttattacaccgggaagagaaaaagttcatatccaccctctcttctttctccccaacccacttcctcttcattcaatcccacataaatcttagagctaaaacaggagcagaaagcagagaaggactattagacctatggtggcatcccaagaataaagccctttaggtgaaggtagaaacaataaatacctgagtagcagaacacgcaaatattatgattttttatgtatgatgttgggttcagagacccataaaatcaggcaataggaaggaaaaggatgctgcttcaatagaaaagtaaactagaaattggacttggaaatatgttcatcaccttaccattgacctgggatttaactgaaaaagggattcaacaaacattcacatgaacagggtctgggaagaaaggaccacgtttaaggatgagtatagagaaaaaaataaaatgaggcatataaaaaagtcaatgggccaggcgcggtggctcacgcctataatccaagcactttgggatgccgaggcaggcagatcatctgaggtcaggagttcaagaccagcctggccaacatggtgaaccccgtctctactaaaaatacaaatattagccgggcatggtagcacatgcctgtaattccagctactcgggaggctgaggcgggagaatcgcttgaacccaggaggcggaggtttcagtgagccgagattgcaccactgcactccagcctgggcaacagagtgagactccatctcaaaaaaacagaaaaaaaagtaacaaattgcctgtaagaaaaccaaagagcatctggcttcagacttctgctctatagcaccaaatgccaggaaacaatagagaattgtgagggggaaaagttgtgactttggaattttatacatattttatatgttaagatacataattttttagttatgataaccatccaggaaatatatgagctatgtaatagtcttacaaagataataagttgtacagcaacctacgaggcttgatttaaataaaacaatgtttgcttagtatcctaatttcagtgggctctgggctattaaataccaggacattatccactagaggaagggtatgtatgcttttaaatagataatatggctagaagctacatatctaaaagcacccgaagtcctcatatgaataggctaaattaatacaataaggtgtaataaatgccataccacagcatcatgtttcttcatttttattaccgaaataatgtataaattgctcttgattttccccaccatcatttaaaacactctatcctgaaagagtccactgcttccaagtgagaaaagccaaggagtcccctgcgttgggggtgtaataacctagactagagcttatagactgaagcccatgtgcttctccatgctcaaacgcagaactaaaaatgggtataaagtcagaaaattgcagaatataagtctgtgtttcaaaaagcaatcaggaaaaaacaaacaaaaaacttgttttagaatacaaatgcaagaaaagttcaatttcaacagcagaaagatggcctggggcagtgagatgctttccttagctgtacttgaagttttatggaacgccatttaaattcagacatcaagggaatgaatgcagttttaaaaatccgaattatttctggagtctacaatgtcagtgttagaactaatgctgggttgttttgttttttcatttgcttgcactggaaggccttgaaaacacacaggagtgtagagtatcgtcagctctgatgctcagtttcttcctggcaatagaatggttttatctgtgccccaagcttttgccaatttaaactctaaactaaattttcaatgacaccagcatgtttgctttaaatttagcaatagaataggcaatggactgctttgcatttccttagtttttcattctgaaacagagcaaaacatcttcccaaagagatggagacaatctcttctgggtagattccaagtataacctgtcccagggtcctcttgctcagctgtgactaacaaaagtctgttcaatttaactacttagataagaagcgcaatgcttttatttaaaaatttaatattttctatggggctgtattttccaaataatagcaacaaaactgtcctaacgttttcactgttctgtaattttgttttaatatagaggatacccataatttcttaacactggaaacatcattctgaacgatgtaggaagcggtcagtaacgtgaatgatgttattgtaccgtctccagctttttccttcttcccccagatggtcgcacctgtgcatacatccctgtgcatgtgggggcacatgagtgggaaagtgggtgtcactcctattttctgtcctagagtgtcagcgttggaagggatttttttttgttcctccagtccggccctctagttgatagtccagtagtctgttaacaatttgtaaggacctgggttatattttaaaggtggttgttgttgttgtttgggttcacttatgtatatgcagcttgactgttcaacccagatttttaaacaataaaaagatttaatgtata

SEQ ID NO: 6082 - DNA, 1671 bp, Homo sapiens
gtacacagggtcccttggggggcctgagagcagccatgaggaggcacagtgagacagatgtggaagagcagacccaggagctgaagaccatcactcagctccaggagcagtgtcgggcactccagatccaaggggtgaaagagaatatggaccagaacaaggccacgctggccctcctgcgcagcaacatccgccgcggggcccaggactgggctttggccaagaagtatgaccagtggaccatctccaaggcctgcgggaaaaacttgcctttgcgactggcgcactgccgcagcaccatggaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtcaagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcgacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacac

SEQ ID NO: 6083 - DNA, 7182 bp, Homo sapiens
gcgtgtttccccaggtcgggcccagccaacgtgacagccgcagacctcggaaaagggcgctccggccccgcctcgaggatttcccccggccgctagggcagcccgggcccgctcggcccagcccctcacggactgcggcgcgcggctccccggggcccggcccgccgaacgcctcgctctacagccctcacctcgcggcgccgagcgcagcgtccgcggcatggagaccggctccgactcagattctttatacaattgcatatgtacgagtggatgaacgtaccattggtgatcccgaggatttttgtcaagattggataaaccatgtatcacattgattgtagagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacga

SEQ ID NO: 6084 - DNA, 4132 bp, Homo sapiens
gagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctca

SEQ ID NO: 6085 - DNA, 576 bp, Homo sapiens
cagagcggctttatggacctcccgaaggagaaggtgggcaggaaggagcaggtggaaaaactagagcttggattcatccagctctctggagcgacagacggcatgagagagtacatcactgaatatgagagccagggggcagtgccaaacacgcggcaccaggagaaggaagacatcatcaggctggcccagaaggaggaggagatgaaggtgaagctgctggagctgcaggagctggtgttgccccttgtgggcgaccacgaggggcatggcaaattcctcaccgctgcccagaaccctgccgatgagcccgctccaggggccccagccccccaggaacttggggctgccgatgagcagggtgatttttatgaagtgagcctggacgatagcgaggagcctgcaccgggagcggccggggagggttctccccatgacaaccccactgcacagcagatcgtgcagctgcctcctgtaatgcaggacacccaggagcacccaggcttgcccggcaacccctgtgtgtcattcttttaccaggcagccgagaacagggagataaacatcatcatctaa

SEQ ID NO: 6086 - DNA, 2656 bp, Homo sapiens
ggaggagggtaaaggaatccacgtcccaagcagagaagcagctttccctacacagcacaggacacggtccgcgcacagaagccgcaggagacgcaggcacaggggctggggagaatccttgctgggccctcgccgtccatgcgccgcctccctctgcccggtgtctggtgtcagcctcctgcctggcagaggaactccagcccctgctccccgaagctcctccaggccttctgcttccctgactcggaatgggcccgctgtccagtgggtacaaggctggtctccccgcccactggtgacgacgtaaagatccagctcagcctggtttcccctggtgatgatatcttgcgactcgtctttctccaggaaaacagggaccgctctccgcctacaggtctcttccacagacctatcttgttttcaccccctgtctcttttggttcagtcttttcgctcatacaaacaaggaagtcgcccctagcccagccgcggctccttagctggaggcgggcccgggggtggagtcaaccgcggtggccacgcctcctgggaaagggcagggcatgcaaattcgaaatgaaagcccggaaaccccggaactagaactggtatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgaataggctgctctcctcagctggcaggaaacctggcagcctcctggtgcccaaggactgaaaaccttagaagcacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggacgggggtggaaggccaccttcgatgggtgcatcctccacgatgacctgctaacaaaggtgcatggatttcagagtctgattggcctacaacagcatttggcttgtggagacagtggttccctgatgaaaaactgccatgatgggaatagaaacaatcagaggaaacttccgtgagttcccaggacacatccacccacctcctccacgtgtaaccaccacctctaccttcccctctggtgctgtggatgagccatccgtgctcctggcaaaggcccacctgccacttgggcacaggaacccatccatccctccttacctctggaaaactcctccaaacacttgtctatatttgtccctgtcattctctctctctcccccctctctctattttttattttattttattttatttatttatttatttgagacggagtctcactctgtcacccaggctggagtgcagtggcataatcttggctcactggaacccctacctcttgtgttaaagcaattctcctgcctcaaccacctgagtagctgggattacaggcgcccaccacctcgctgggctaatttttgaatttgtaattgagatggggtttcaccatggtagccaggctggtctcaaactcctgacctcaagcgatctgcccacctccgtctctcaaagtgctgggattagaggtgtgagccaccacgcccggcctatttatttttttgagacagagtctccctctgttgtccaagctagagtgcagtgataccatctcggctcactgccacctctgcctcccaggttcaagtgactctcctgcctcagcctccctagtagctgggattacagccatgcaccaccacacctggctaatttttgtatttttagtagagatggggtttcaccacgttggccagggtggtcttgagctcctgacctcaggtgatctgcccacctcagcctctcaaagtgctgggattacgggcatgagctgctgtgcccagcctcaattattttaatctttgaataacttcggacttgcagaaaagttaaaagacttacatggagaacttctctaccctcttccccatccccgcaaggtacacagttggtaaagcgagaagtctggggttcagtgacacacttcttaactcccaagttcgtgctctttcttttctctctctctctctctctgttgtctctccctccctccttcactccctctctctccccttgatggccacatttactttataattttctctctcactctttctctgtctcactctctcttacacaacacacacactcataagaagacacctatatacatttttttcctgaaccattggtaagtaatttgcacacaggatgtcccttcaccccccagtccaccaatacttcggtgtgtttcctaagaacaaaggccttctggaagtttcacattaattccatactggatctacagtccgagttcagatttcaccaattgtcccaataaagtcctttaggtttttctgg

SEQ ID NO: 6087 - DNA, 5031 bp, Homo sapiens
ctggcaacagggaaggggcggctctcgagaggagcccgtgggctgctggaccggaccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgacatgaagctgcaagatggcaagagacttctggggccccagtggctggactatgactgtgaccgagctgtgatcgaggactgggtgttcagggtcccccatgtggccatattcctgagtgtggtcatttgcaagggctttctcatcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggtgcctgctcttttcgtctgagctccatggacacagcttctcccagctctgtggccacatcactcaccggggaccctgtgtggctgtcctcgaggaccatgacaagcatgtgttcggtgggtttgcctcttgctcttgggaggtgaagcctcagtttcaaggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaacgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttctttttttccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactgactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaaggtcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatcagggccctagaaagtgctaggaggaaggggttaaaaaaaaaatttgtccgcgttgcaaactattataaatgattgccacattgcaagctattattttctcccaccatattttttaattaaaaaaaagtctggggccgggtgcggtggctcacgcctgtaatcccagcactttgggaggccgaggtaggcggatcacctgaggtcggaagttcgagaccagcctgaccaacatggagaaaccccatctctactaaaaatacaaaattagctgggcatggtggcacatgcctgtaatctcagctactcaggaggctgaggtagtagaattgcttgaaccagggaggcagaggttgtggtgagccgagatcgtgccattgcactctagcctgggcaacaagagtgaaactccgtttcaagaaaaaaaaaaaggctgggtgtgatggctcacgcctgtaatcccagcattttgggagcttgaggcaggccgattgcttgagcccaggagttcaagaccagcctgggcaacatggcgaaaacccatctctacaaaaaaaaatacgaaaattaaccaggcatggtaacacatgcctgtggtcctagctacttgggaggctgaggtgtgaggatcatttaggcctggaaggttgaggctgctataagctgtgattgtgccactgcactccagcctgggcaacacagcaagaccctatgtttaaaaaaaattgtgtacctggtttagaaaaaaaagataaaaggatacaacttaaagtcagtcatcttcctgcctcttctccagctattttccctcctgacaggcaaaggcactgatgcaaaaatcactcaggtctcctccctgtgacttggtgcacacctgggcatcactgtcttttacacactgatgtgtccctcgctttcttttttaaagggaggtccgtaaccacccacctgcctccctcttgtctttatggactgcgtgatgtcccaccatatggatgctctcgggcctagcgttccaccgtctgcagctggggaacattttgtttgcagctaatcattgtcatgaatatcgtttatgtgtgccttgctgtgatggtgtctgtgggataaactcttagaattggaattgttggattgagaggtatatgccttttatttagatatagatgaattaaaaaaacctcttgagctcaatttatactcaatataccggggtgcctgtttgccatgttttcagcaaaactgtattaaaatatgtttttttaa

SEQ ID NO: 6088 - DNA, 3516 bp, Homo sapiens
gttgtcctcctccaagtagcggtaactgcgcaccttgtgctggggccacgggatgcggggctggcgcacgccccgccgcagcttctgctccatccgcaggtaggagaccgcggccgccaccagcgtcaccagcagcaccgccagcttagcctgggggtaaggagagggatgccagggagccgcggccgcctcgccccgcaccttccccgcctatgcccctcgctgagataggcccttccctcctccgggagcctcccgggccacgcggccctcaacttctccagcccctccacccacgcttcctggaccgcctcctgcaggcgaggctcacatccagcactgtcccttacagtcgtcatgcccctggcgacctcagtgtcccacgctgtaagggaacaatacaaatcccttcgcctcatagggtgcatgcgccagtgttgataaagtgctggacacaggccctgccttcccagggctcacaacactgtgtccctgacacacccgtgggctgtagtgatgctcttcatggggttttgactataatccgcagtcaggaatgattttacaccatagctcaggacatacacacatatctgtatgcatacttcctgctcttttcttttttccagacacagtcgctccatttccccaccgcgccccctccctcccttcccccacccactgctggagcgccagtggcacgctcacttcagcctcaatcttccaggctcaagctatcctcccacctctgtttcccaagtagctggaactacaggcatgcgccaccacgcccagctaatttttaaattttttgtagagacagggtctcctatgttgcccaggctggtcttgaactcctggcctcaagcaatcctcctgcctcagcctcccaaagtgttgggattacaggcgtgagccaccatgcccagcccactcactgcttttcttttttcttttttttctttttttttttttgggagacagagtctcgctctgttctccaggctgaagtgcggtggtgcgatctgggctcactgcaacctccatctcccaggttcaagccattcttgtgcctcagcctccagagtagctgggatcacagggacgtgccaccatgcccagctaatttttgtgtttttagtagagacagggtttcatagcctgttacccaggctggtctcgaactccagatctcaggtgatacacccacctcagcgtctcaaaatgctgcgattacaggcatgagccactgctcccggcccactccctgctatttttagttctatttttatttttattttgagacggagtttctctcttgttgcttaggctggttggagtgccaagaccccgtctcggctaactgcaacctctgcctcccagttcaagcgattctcctgcctctgcctcccaagtagctgtgattacaggcacctgccaccacgcccggctaatttttgtatttttagtagagacaaggattcaccatgtcggccaggctggtctcaaactccctacctcaggcaatccactcgcctcggcctcccaaagtgctgggattacaggcgtgagccactgcgcccagcctttagttctatttttaaaaaatgtttagcaactgggacttgctagaccgagccaccatcttttgggagcagagcatgagaagcctgctcccgttcaggccatgaagggagacagacccaacatctggagaacagggtaccaaacagcccacaggatggctgtgatgcacccacaaatcccctcagagatgggcaaactgagactggctggaggtgggccagtaagtgaggtgctgagttgggggccacccagtgggctgcaggaatggggccttggcccagagactggcttgggaaggggtggcgtttaggaagctgtgaagccagggcaggggctaaggaagtatctgtcattcggcatggggcccccaaccctgcccagtctcaccttcatgtgcaggctcgagcccaggtacacagtgaagatggccacagcctgccaccagtggtagatggtgaagatgaagtcctgtctctccttgtcttcgtacaagactcccaggagtgctgcaggcaggcagtacagggcaggcaggggagaggtgtcacctggggcctggggctgccgagctaccatctacgaactttactaagccctgtatgtgtcccagcccgggaccagagagcgcctagaaagtgctgtgaggcggtcctggcctgccccctggtggagaccctggtcaccacactgctcacacgctaagcagaagtaggagcaggtgcgccgggctgtgtggatgcaggtggtcccgctccgcaccacatgcgtggcctcaaaagaagaaagctctgtgcttagtcatgtcctgtccccaaccccaggtgtacagtgccaagcttgcaggcgctgtttctcctcctcagccgggactagagagatcgaactgtttgcagctgccaactctgcaaatcaaacctgaagctaagcatggagaggggggcttcctttccagtgagtcctcccagggtgggcagcaagagtaatggattgggagtcagaagatgcacactcattctcaggactgtaatgttggctccgtgggtgatttgggtacttaactccccagagctgcttttcccaatggtgagatgagcttatgcctattgtgtgctgtgttctgaagttctaaagtgagaaagagggcatggcacctgccagatcataggggccactataaacaccttcaccaggcactcaggacatgaacactcctgtcttggggccttgcagggtgactttacccccacagctatactcactgctgagtccagtcttgttcagggtgctgcccacaagcccagcaggcccaggagtgaggcgactgaggcgcccaggctgtaagccatgaggaggtccactgtcctccctgtgtggtgcaccatggaggctcagactccatcctcaaggctggcaagaagacaggatgagacatgagcctcctgatacaggtgacgggagtggagcccacaggactggaacctcacactgcagggctggaggcacagactgactatttactattctgtggcctggggggctcaaggcacagagctccttattagccaaagtcacccaagttccccaacctctaaggatttccttataataatgcaagaagaagaagagaaaagtgagtgtccatagaagctttggggctcttcctcgaatcaggagaaagctggaggtgttcttccctggacgccatggtgttccctgcacttgggtgtggaccatcttcttcttctccctgggctgactgagatgctaggtctgaccccacaaggccaggccgacattcctgagtgatcactaagaaccagtttctcaaccaccactgggattctgggtcctcctgggctgctgcctgttctcctgtgacccacctgtgagcaagaaggtctccttccttcctgttgtctccatctattt

SEQ ID NO: 6089 - DNA, 3552 bp, Homo sapiens
gaggaggtgtttgcccaggtgcggcgcacccaggcaggcgagctctccacccaggtgggttcttttgtgtggagtcacatcctgcagctgctggagacgcacgaccccctgaaacgggccctccgggacaccctccccgaggacatcctcagccaggagttccacccagaaatgtggaaacactcgtcctattctgatgtcaccttccgatcagcttgggctccggctggaaaatgctgaggaaattgctcacaggctgtttggcaggaagtcattctggggtcaggaagacgggagagagcctgagccagaggaacccccagggccagaaccagggcctgcaccacagccagccagccccgagtgtccaggagacagagacagaaggatgagatacctacagcagaaggtgacccggaggcgtggggcccggcaggctctgcgatgcgagctgagcgtgaagttgctggggcaggagctgagctttgtgaactgcggggccacggggagtcacgtgaaccactggccccttaacttggccgagctcgccatcaagctcatgaaggggcaggaggtgcagatgaaccggaggctgagcctggccgcacaggaactggtctttcccaccgtgtctggccttcctgcccggctgaccctaaatgcctcggctgccatcagcatccgggtccgaggaaccactgacttccagcagcgctcggatttctctgtgaatggttatgtcaagcccagtgccctgctccagatctcagctcagatgggcacagcgggcatcctggggcaggccgggctgaggtgggtgaccagcgtccgcagcgccgccagcctggatggcgggatccaggtgcagaagggccgggtccttaaggtgcatctgaacacgcctgaggaggccgtggagctgctcagcttcagctctcagctgtacctcatcaccagggatggcgtgaggagcctcagacatgtccctggcccttctgaggtccagtcctgtactggtgaggaagtgtcctacacctggggctggcgactgtgcactggagtgacctggccggtgcctggccagccctacctgctctcattgcctgtgttcgcggccgtgacgctgcagaaacgggacccggggctccgacagtacctgctggaagctgcctataccctgcagccccagaagggcagctggttcccccaagaagccacagcccacgtcttcatgggcacgcccgggtcagaagtgctgagggacgtcggggtggacatgagctacagcttgccccagaacaagttccggctcaagcttctccatcccaagaagaaaatcgagctggacggaaagatggaggctcttgggagtgcccacacgggtcacttggagctggtgctggatgacagggacgtctactacatcaagcttggcagctgggcgccgtggctcacgcctgtaatcccaacacttggggaggccaaggaggatggatcacttgaggccaggagtttgagaccagcctggccaacatgggctggagtgacctgcagccagccatgggtggcgaggctgagcggttccaggcgcagctggaggtgaaactggtgacggggggcagccccgtcgtcttcaccgggaacctcacacggcaggtgggcagcaagctggccttctccgcatcgctgagccatctgctgagtgaccaggccaacgtgacagcactgctggagaggaaggaggagaatggacggagggtggccgccctgggtgccgagctgtttgtgccagggctggtggggcttcgtgcccttggcctgctgcagcaacggggccagctctggaccaactccctgaggatccagtacagcctcctgggtcaggcaaagcaggcggcacacgagtgcagcaccagccagaagctgcgggcagacagtggctcagacggtgcctacaggctggagctgcgccacgagctccactgcacacagatcctagccttcagccacaaggtccagctctggcatgaggaggactcgggccacctgcactcacagctggaggtgagctacgggaagcactgggacaagaacagcaacaagaggcatctccgtgtcagccagaccttcaagaatgactcggggcccgccctgagcaatcacttcatggagtttgtgctgcaggtgcctgagaggcaggtggattgccgcgtgcagctttaccacttgagcctccgcctgccctatgtggagagcagcagtcacctgaaggtgcagtacaatgggcggccgctgtttgtggcaggcgggcagtggaaggacacatctcgggccaccctgtggaagtgggaaggagccttgaacctggatagtccatggctgatggtctctgcagctcacaggctatactggccacaccgagctgtgttccaggctgtcctggagctaacgctgggcaaggcctggaccctaaaggacctggtggtcagcgtgggctgcaggagtcagggccccaacagggaaggcaagatccaggtttacaccgcagctaccacctacctccgggtttccacagtgacagtcttggcacagagcctcttccacagctggagcgaactcgagtcagcctggaacgcagcagtgcagggcgagatccatgctgagaacagccgggaccgtaagatcctgaactgctggttgaaaggcccccagcaggagctgaacctaacagcggcctacaggcacctggagtggccccggaagacccaggtgtcgctcacggctgtgcggattggtgcccagggccagcctcggggcctgcagttggaaggagagctggaggagctgaggcaagacaggacattgtaccggaaacggggggccttgctccttaggcacccgttgcacctgcccatcccgcagagcctcctcctgcaggagaccttcacagctgataggcgacaccagcgctattccctggagactagggttgtcctgaatggccgagaggaaaccctgcagaccatggtcctgggctgccaggccggacacccctacgtctgtgcaggtctgatgcatccatacgatggcaaagtcatccccaggaacacagaggggtgcctggttacttggaatcagcacacgagtctcactctgttgtctaggctggagtctggagtgcaatgacttgatctcagctcaccgcaacctccacgtcccaggctgggcgagatggctcacgcctgtaatactagcactttgggaggccgaggcaggcggatcatttgaggtcaggagttcgagaccagcctgaccaacatggtgaaacccccatctctactaaatacaaaaaaaattagccaggcatggtggcgggctcctgtaatcccagttactcaggaggctgaggcaggagaatcgcttgaacctgggaggtggaggttgcagtgagccgagatcacgccactgcactccagcctgggtgacagagcgaggctgtctctaaaataaaataaaatataaaatagaataaaataagctgtttaatgacat

SEQ ID NO: 6090 - DNA, 3359 bp, Homo sapiens
gtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttg

SEQ ID NO: 6091 - DNA, 1093 bp, Homo sapiens
gctccgggtcacatactcgtcctgagccggcttcagcctctccgcgcagaagtgtcccggagccatggccgagtactcttatgcgaagtctaccaagcttgtgctcaagggaaccaagacgaagagtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatccactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagagcacaaacttaaaataagtaaagaagacagtaaaattcttaaaaaggctcagaaagatggatttttgcaagagacgcttctggacagtttaggctatgagcatagatggaagaggtggctgttgtattggatcaaggatatgagcagagatggatgaggcagcggctgtaatggttcaaggctatgaacatcttgtgaagtaggatgttaaatctgcaaatatcagagtgaatccaaacttatcaattcaacactggattgtaaaacagctcaaaaaaagactaaaaacacagctctacactttaggaggttggggcaggcagattgctcgagctcaggagtgggagacaagtttaggaaacatggaaaaaccctgtctctaaaaaaaaaaaaaaaattgaattagctgggtatggtggtataagcctgtggttccagcttctcaggaggctgaggtgagaggattgcttgagcctggaaggtgaggctgcagtgagctctgatcacaccactgcattccagcctaggtgatagagtgagaccctgtctt

SEQ ID NO: 6092 - DNA, 288 bp, Homo sapiens
gaggtgcagctggtggagtctggaggaggcttggtacagcctggggggtccctgagactctcctgtgcagcctctggattcaccttcagtaaccactacacgagctgggtccgccaggctccagggaagggactggagtgggtttcatacagtagtggtaatagtggttacacaaactacgcagactctgtgaaaggccgattcaccatctccagggacaacgccaagaactcactgtatctgcaaatgaacagcctgagagccgaggacacggctgtgtattactgt

SEQ ID NO: 6093 - DNA, 1188 bp, Homo sapiens
ggggagtctgaagatgtgactcaattcctgcaatctcataagaaaactttaactaatgagaagttgtttcttatggacgggaaaagaacgtggtttcttgagatggaatctactcctggtgaagatgctatgaacactgtcaaaatgacaacaaaggatttaaaatatgacagaagcttaattgataaagcagggtttgagaggactgactccaattttgaaagaagtcatactgtgggtaaaatgctatcaaatagcatcatgtgctatagagacatattttatgaaagggagagtcaactaatgcagcaaacttcattattatcttatgaaattgcgatagccaccccaaccttcagtaactactaccctgattggtcagcacccatcaacattgtggcaagaccctctaccagcaaaaagattatgacttgctgaaagctgagatgatcgttagcattttttagcaataaatatttttaattaaggtatgtatgttttttagacaattctattacacattttatagactacagtatagtataaacacagctttttttttttttttttttttttaagaaatggggtctcatgctgtcatccaggctggagtgcagtggtgcaatcatgactcactgcagcctcaaactcctgagctcaagtgatccaagtagctgggactacaggcctgtcacatcacacccggccaaaacgcataacttttatatgcaatgggaaacaaaaaaatgtgtgtgactcactctattgtgatattcagtttactgcagtgatatggaactaagcccacaatatccctgcggtatggctgtacagtataagaatcacctgaagggcttattaaaaacagcttgcttgaccccctcccttagagattccgattcagtagatctgggttggtcaagaatttgcatttctaacaagctcccagctgaggctgaggctgccattcaacatactaccaagtagcactggcatagagagatccctggaataaaatttacctacttgtgtgtgtgtgtatgaatgtgtgtgtgtgtgtgtgcgtgtgcatgtgcgtgtgtgtgtatacagtcttgctctgttgcctgggctggagtgcagtggcgtgatctcggctcaccataacctccgcctcccagctttcaagcgattctcatgccttagcct

SEQ ID NO: 6094 - DNA, 1740 bp, Homo sapiens
ctcaacatcataaggaatcagacggatgcggaaaccgagacgggctggatgggaaactctttccaggaaggctccggggccctcagctggtctccgaccttcccctgcaacctgtgacacctgccattttcccatcttaggcgatggcaaagccacccttccgtttgctccgggcaaaacttcgagagttccctctgactctggagttttttcctcagatccaagagccaactggtcatcaattcgtaatttcccatcggctaagtgcgtgggcattgagctacacgagagtctctccacctctgcggaatggctacttcggggtaggggaggggccctcccgtggattgtaaggtgtttagcagcaacggacctcttgctgccaggaaagaaaggcgtcgagtcctgtcctgttgggtaggcggaagagcgatcaaagggaagacaagaaatatcctgggaggtttcaggatctaaagttaccatgaagtcaacctaacctcctctggaggtcctcccagtcctcccgtggctggcgatggtgaatcgagtttccgtctccagtttgccaaggcagacaaagccgacacaatgggcctgtccactatcttctttcatatacacaaaatgtcagctcttcctgtttctaactggcaacatcccgcctgatgaccagcttagcaaattagagactctccatgggattccatctgtgtcttagttcgggcttctctaacactgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcacgctgctgacaaatacataacatagtccgggacgaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccagcagatagtgagacttattcactatcaggagaatagcacaggaaagacccgcccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggtttactataagctattacagacgaggcatcaggagtgacaaatagataaacagactgagttaagagacttgaaactgatccacagctatacggtcaataaatgggttttcaataaaagcagttcaataaaag

SEQ ID NO: 6095 - DNA, 288 bp, Homo sapiens
gaggtgcagctggtggagtctgggggaggcttggtccagcctggggggtccctgagactctcctgtgcagcctctggattcaccttcagtaacagaagcacacactgggtccgccaggctccagggaaggggctggagtgggttggccactccgtctcaaaaaaaaaaaaaaaaaaaaaaaaaaaaaaaaaaaaagggagattcaccatctcaagagatgattcaaaaaacacgctgtatctgcaaatgaacagcctgaaaaccgaggacacggccgtgtattactgt

SEQ ID NO: 6096 - DNA, 2707 bp, Homo sapiens
gcaattcacgatatgcagtctccgagatgaaaacaaaagtgagaaacaaatacatcagatgatgctatgcagctctgaaggaagaacatgtattgccaggactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctttgcaaagcaacagataaacttggagatgcccaactccagagcgacaacagagttagcctgggtctgcagctccacctcaagaaaaaagaagtgggcaaggtccctgactctttccactgctccactgagccccccaccatccttggtgcactgtgaagattgttcttgcctgcctggctgccattcgggtgacctctacaatctggccccagcagaaagaacttgctagcagcatatcaatagcagagatggaagtctggtcatatggtgcccacatctattgaagtaaacatgctgataccagatatccctggctctctgtcttcaaggcacatggtagaactatacttcctagctttctgtgtggctgggtgggtcacatgacaagttcagacagatgaattatgattagaagcatttaattgttaatacatattctagtgctctttccctctgtcatcacaactgacaatgtttcagacagtgacttctccaacaggctggttccagagtgaaaatagagcccagtagagtctgtagctgatgcaatatggacatgtagggtgagtgagaaaatgcttttgttgggttaagcatctgaggtttgatggtttgttgctactgcagcacaaccttacccatcctaacaaatatgactattattgactaacctgacaacagaagagtctttccacttctgctgtgatgaggaacagagttttttccctgttatatcttaatattagatagcagcagcctctggaaatagttctttctctaccacttcttacccatgtggcataaagccagctactaaacctcttcacttttcagctttcccttttaaaagtgggagtaaataagacctttctcatggagttattgatcaaatgaaataattaaataacgagtatttaaattttaaatttaaatgaaaattcaaatgacataatgcctatgaagtacttatttagtccataatatcctcagtaaatggtagttagccttactaacacaaaggaaatggacaaagccatgccattttccaaagtagtttctaggaccatattatctctaaaaatcccaactttctgctgtaaatttgaactaatccagaacaggctaatccattgcaatggcctattcatccttcttcttagagtttagctatcagtcatcttgttgctgagaacaaagccagcctagttgtttgtaagcaagcctctagagagacagaaactgtcttgtatttctttgaatatcctctactgcctctaacactgtgcctcggctatatttctggatctttatttaattgttttgaatgcttcttatgtttaatttctgccatatccattaggaaaacaacgtaatccttcctccaacaccgatggtataagcctccatgaccgggaaacatttgcccccaagtttaaagaatttagttctgtaaggcttgttgacccatctgacaggaattcctgtaccaagtggtcagtcagtgaagatctctttccactggtaactttatcaagaaagtaagatacaagactgtatgtaaagtatattatcctatgtgaaatcaagggacagaaaataactggaaggaaatattccaaaatgttagcagtagtttctcccggagaatgtgatgtatacatttggatgggtgatatataaagtacttttcatagatctgggcaagagatattttagagggctccacataccacaatcacccacaaataaatgtattaaagagcacacagatgcctttatcactcaggatgtggcactcagagctggcccagcatagtctataacacttaacatcactctcatgaccacactgctcaggtcctagggaagtgtgcctctgtatctcttccctgtatccttaaaagaaaagatgacctaatttgaaagttgataaaaatcagggattatgatgatgttgcttcagaattcttggaggacgtaagagaaaaatagtgctgggttatgagaagaacaaaacttaccaaattcctccctgaagataacataaatgcaatagattcttttacaacaaagtgtcatttctcaataatgccaagaatcctttttcatgcttctcttcttgttcacattcctggttcccatgctactcaattaacataatattcagaaaagttgcagatggtgatttaggaacatgttgtaatattaacatttcatattacccttaaatttgcatgcatgcatcatatgtgtatcatggtaccaattctttatattggtaactaggtggatatagaacatttacaatgtgaatagtgttatctctataaaaacaagatttaattaaaatgttcatatatgaaatgaaattttggcatatattaattataacttggattttaccttttaaagttaatagatcattttgaatattttaaaagactttaataaacatataaaat

SEQ ID NO: 6097 - DNA, 2534 bp, Homo sapiens
acccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataa

SEQ ID NO: 6098 - DNA, 942 bp, Homo sapiens
atgcaggaggcagatgctagcattaagactgcggaaacaaagggaagaacttggaagtatcaaaacatagagcctgggggaggacctcagacctctgggaaagggggctttggcagtctggtgctggtgtttctggggcagagggtagggtgtaacgagactggttccatgaatttggaaaaactgcaaactagacccaacatgactatttttacccgaaacaacatagccacgaatttctcctcctcctcctcttcctcttatttttcccctcctcctcctcctgtcctccttcccctcctccttcttctcccccaacttttttcttcttcttcctcctcctttttcttctccttttccccttctacttctcctcttgtttctccttgttttttctcttcctcctcctccttttgcttctcagtttctcttcttccatcttcttccccaacctccatgactaagtttccaaaagcagttacgacaaaaataaaaactgacaaaagggacctgattaaactaaagggcttctgcacagcaaaagaaactatcaacagaacaaacagacaacctatagaatgggagaaaatattcacaaactatgcatccaacaagggtctaatatctagaatctataaggaacttgggcaatctgacaagcaaagaccaaataaccccattaaaaagtgggcaaaggacatgaacagacacttctcaaaagaagacatacaagtggccaacaaacacgaaaaaatgctctcaacatcactaatcattggaaaaatgcaaatcaaaaccacagtgagataccatctcatgccagcaaggaaagctactattaagaagtcagaaaataacagatgttggcaaggctgcagaggaaagggaacgtttacacactgttggtcgaaatgtaaattaaaatgtaaatgtaaaatgtaa

SEQ ID NO: 6099 - DNA, 864 bp, Homo sapiens
gtcttcttccttactggcatccctggccttgaaacccgtcagatctggacctccatcccattctgttgtctctatgtcattgctatctctgggaatggcatgatcctgtttgtcatcatcactgagtcaagcctccatgaacccatgtatcattttctctccatgctatccttcatggacctaggtctgtgtctttctacattgaccaccatgctgggtattttctggttcaatgctcgagaaatcagttttgatgcctgcattggccaaatgttctttatccatggcttcacattcatggagtcctcagtacttttggcaatggcctttgaccgctttattgccgtctgtaacccactgagatatgccacaatcttaaccaattcacggattattaaagtgggctttgcaattgttcttaggggaacaacagctctagtgcctctactcctgctccttaagcgcctctccttctgccgtagtcatgtgctccaccattcctactgcttccaccctgatgcgatgaagctctcatgcacagacacatggatcaacagtgcatttggcctggccattgttatctctactgctggcttagactctgtcttgatcctcatctcctatgttctgatcgtccgctctgtgctctgcattgcctccccagaggagcagaaaaaggcttttggtacctgtgtctctcacatcagtgcagttgccatcttctacatccccatgatcagtttgtcaccagtgcacagatttggaaagcatgcccctccccttgtgcacatgctcattgccaatgtttatctgcttatccctcctgtaatgaatcccataatctacagtgtaaagaccaagtaa

SEQ ID NO: 6100 - DNA, 1740 bp, Homo sapiens
ctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaag

SEQ ID NO: 6101 - DNA, 10490 bp, Homo sapiens
acccccatgaatccacaaccataaccatggccacgcgggtcgaggtgggctccataacgcccttgacggccgtgccaggcctgggtgagatgggcaaggaggagaccctgacgaggacctacttcctccaggccggcgaagcctctggggctcccccagcccggatcttggaagcgaagagccccctgcggagcccggcccggttactccctctgccaaggctcgcccccaaacccttctcgaaggagcaggacgtgaaatctcctgtcccgtctctgcggcccagttcgactggaccttccccctctggggggctctctgaggagccagcagcaaaggatctggacaacaggatgcccggcttggtggggcaggaggtgggcagtggggagggcccgaggacgagctcgcccctcttcaacaaggctgtgttcctgcggcccagctccagcaccatgattctcttcgaaaccaccaaaagcggccccgctctggggaaggcggttagtgagggggcggaggaggccaagctaggtgtgtccggctcccggcctgaggtggctgccaagcccgccctgcccacccagaagcctgcggggacccttccccggtcagctcccctgtctcaggacacaaaaccacctgtaccccaagaggaggcaggccaagaccatcctccctcaaaggccagcagtgtggaggacacggcacgcccccttgtggagcccaggcctcgcctgaagagaaggcccgtgtctgccattttcacggagtccattcagcctcagaagccaggccccggcgcagcggccacagtgggcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattgttttcaagttcagcttccagcaacgaagtcaaatatgagaagagtgctgagctgagcggcgagtttcctaaggaaccgagagaaaagcaaaaggaggggcacagtttggatggagcatgcatcccgagaagcccctggaagcctgggacactccgggataagtccaggcagacggagcagaaggttagctctaaccaagaccccgacagctgtcgcggtggaagctcagtggaggccccgtgcccttctgacgtcactccagaggatgaccggagcttccagactgtgtgggccacagtatttgagcaccacgtggagagacacacagtggctgaccagtcgggacgttgtctctccaccacaccccctggtgacatggcccatgcccgtgtctcagaacccaggccgaggcctgagatgggctcttggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagtacgttgcctcgggagaggcctgttcagctgggcggggtggagcagagaaggaggagcctgaaggagatgcccgataccgggggtctctggaaaccggccagttctgccgaaataaatcacagtttcactcctggcttaggcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggcctgtccatcatgcatgaagccagagagaggaggcgagagcagcccaaagggaggcccagccttactggagagaatttggaggccaaaatgggaccctgttggtgggagtcagggactggagacagtcacaaggtgctgccacgggacctggagaaggaggatgccccccaggagaaggagcgaccgctccagcaggtgtcccctgtggcctcggttccctggagaagccacagcttctgcaaagacaggaggagtgggccctttgtggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggctacctctcaggagttcatttgtctctctgtctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagatcatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtcgaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagattttttttccctaatctctcataccttaattggaaaaataatcaattaattctatgttaattaggatatacaaagttcaccctccttgaaagtgactagggcaagccctgaagatcttcctcacctccttttatttttctataaccttgtctcctccagcaccacagggaagacaatcacagtgggtcaagagcgaccctctttcacgtgggctctgccatgacctctgagacctgcttatgatcagtgcaatgaagttagaagtaactgatgattgggagcctttgcagatagctgggcaaatgggtgatttacttatccccattctaaatggagtgagctctctttgaggctaagcaaggaggcgttgtatgctagtttctagactttgcctggagacccctttggaaatctgtcttctttttaaactcacttaatatgccttaatcatctgtgtgtaatggagtcatccgctcctcaatctaaccctcctcccctggggctttggctgtcctcaatgagagtttcatgcagaatggaaaatcctctatatgtacaatctctctccccctcatttctcttcctcctcacctccaccacccctttgcacatcagcattttaacagctgatcttttgagaagcctgtatctttttcctcttcagtagatacccttcttcatggtcctttgcctaatcaaacagaggcttttggcctttgaaaatccatgacaaggcctcagaaatcagtgttgtggaggattactccatgccaccggagaaactctggtgaaagagaaacctcgtggtctttaggatgttgggattttgagtgaacctgacctgatagcctcaggattcagggaaaggacaatcagatggcggtgttttccagggggacgcgccaaatcatgtggtttcagacaattgtgtttgcctttgtgcctccctggaagggaggccaactaagggtatcaccaagaagccaaaagagaaataggcatgagcctgtggttttaaactttacaggctgggcaaaggatttagaaagacccttagcatgattttcctaaaagagaccttagctgctccaacctggtgctgatagctgctttgttgatctatgctttaaaatttttctttataatgcccccagatggctcctggaactagtcgtaattgcaaactgtaaaaatccctcctccccagtgtagatatttaaaccagagtaagtgatggggagacattctgtggtctctgaatgtgccttccccctcaccgtgtgttaaaacacaaaagccgaagttccatggcatcatgattccgaggggctggagggataggacccactccacatctaaaggggatctgctttgggctcggtcccattagcgagtgggggactcttgctgtgtgctaagaggctgctaggactcacccagttggaattctgggtgggctcaggaagtttagagccacgtaaaaagctggtaggcatgagtgtgccaggtctttgccagcctgcgtctccttttgcaccccccaatccagagtttgctttcttttgactaaattggctcctgcagggggaagggcagaaagctaggccctctgctctggaaagtcggcctgaggtttccggcaagttaacccttaaaatggacacccctcagcccgccctcccctttggccttcccagaatctccttcagtggttgctctcacacctgtgccataacatcatcttccatgacttggacgggcacttccttgacaattcctattggcatcacacgggctacaaattatgctgttttctaaagaatttgaacttttttttttttcttttcttgagacacggtcttgctctgttggccaggctggaatgcagtggcacaatcatagctcactccagcctccaactcctgggctcaagcaatcctctcatctccacctccagagtagcctagatgacaggcgcacatcaccacgcccagctgatcttttaaatctgttttgtagaaacaggatctcactatattgcccaagctggtcttaaacttggtctcaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttctgggtccttcctcagatctttgagtcacgatagaaaaggagctcgagttctttgtgtaggaaagttaagcttcctgcctgcggtgttcttgcaattgccttaggaattcacaagctctaggagttctgaacggaaggcagacgagaggcactttatccagtcccagaaagaatctctaaccgtgtgactgagaagtcatctagaaaaacttatatttttaatgtaaaaacaaatggggcttaccagacctcacagagtattggacgtctacaagtgcttttatattttgtaactgtaaagaagtttcatatgcacagaagagcagttggaaatctggtcgactgcaataaaacaagatgacctttgcatgtacaaagatgttgcattcagactatgaaaatagcaaataaagctttggtgcaagttgcattgg

SEQ ID NO: 6102 - DNA, 2025 bp, Homo sapiens
atctgccaggacggtctttatagatgttgaggaggtcaagaataaatcttgtttgacctttaccgatgatggatgtgggatgacacctcataaactacaccgaatgctcagttaggaatccaacttacaggggatgtgaaggacctcttcaaggagaactacaaaccactgctcaatgaaataaaagaggatacaaacaaatggaagatcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaaggcaaaagaaaaaagctggaggcatcacactacctgacttcaaactatactacacggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatctaataaatggtgctgggaaaactggctagccatatgtaaaaagctgaaactggatcccttccttacaccttatacaaaaattaattcaaggtggattaaagacttaaacattagacctaaaaccataaaaaccctagaagaaaaccttggcattaccattcaggacataggaatgggcaagcacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcacaacctactcatctgacaaagggctaatatccagaatttacaatgaactcaaacaaatttagaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccactatgagatgccatctcacaccagttagaatggcgatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggactataaatcatgctgctataaagacacatgcacacgtatgtttattgcggcactattcacaatagcaaagacttggaaccaagccaaatgtccatcaatgatagactggattaagaaaatgtggcacatatacaccatggaatactatacagccataaaaaatgatgagttcatgtcctttgtagggacatggataaaattggaaatcatcattctcagtaaactattgcaaggacaaaaaaccaaacaccgcatgttcagactcatagatgggaattgaacaatgagaacacatgaacatacgaaggggaacatcacactctggggcctgttgtggggtggcgggaggggggagggatagcattaagagatatacctaatgctaaatgacgcgttaatgggtgcagcagaccagcatggcacatgtatacatatgtaactaacctgcacattgtgcacatgtaccctaaaacttaaagtgt

SEQ ID NO: 6103 - DNA, 60 bp, Homo sapiens
atcatgccattgtactccagctcaggtgacagaacccccatctcaaaaaaccccacaaaa

SEQ ID NO: 6104 - DNA, 3839 bp, Homo sapiens
aagtccgggcagcggttggcccctgggcacgcggggtcggggccgcccctggtccaccgctgctgctcggtggctgggccgtccgcctccacccctctcgcagtcatgtgcctggcagggtgaggggcgggggccggcgatgcccgcgaggctgccccccagactcctgggctggaaggagcgattggccgccgaggtgggaaagcaggcctgcgccttggggtctcctcgaagtgtgttccttattccctgcatcctgatagccctggtcggaggaatccccattttcttcttggagatctcgctgggccagttcatgaaggccggcagcatcaatgtctggaacatctgtcccttgttcaaaggtgagcagcccttggccagcctcagggactgcccccttttcccagctggctcccacttgagaaatcttttcctgtcctgagcaccaggcctggggccacgtgatggcatcccagtctcgaggggggagcctggaggagatgttcaggccgcacagtgaacttggggaagcagggactagagggggcataggcagctccacaaggcaaggacaggccaggcatagccgggctggggatgggacctgcccagcacacttggctctctaggtaggtcctactattactgtccccaaggacgctggggcacagacaggtggagcgacgtactgaggttgcccactacgggggcaactgtctccaacactacctcaggctactagaaactccccccctccccaccaccaccaccaccagctgctgaggactggagctactgggtggccaggtggaggcttggacctcctggaaccgccatggtggcagtgggacccacagaaggggccaggtgtgtaaggctggagactcaacagcacttggtcagatggggacaggaggagaggggctcgctctgccttgggtctagggggcggctggaggagaggagagaggctggggagtcagcccagtgttggggctcacacaagggggagtccaggggagtcaggagcaccacaaacaaggctccagaaggacagacggtgggagcactgccagcctgggtggggagataaaggggtggcaggggaggtggccaggaaagaatctacatggcaaggacttcccggccccaggcctgggctatgcctccatggtgatcgtcttctactgcaacacctactacatcatggtgctggcctggggcttctattacctggtcaagtcctttaccaccacgctgccctgggccacatgtggccacacctggaacactcccgactgtgtggagatcttccaccatgaagactgtgccagtgccagcctggccaacctcacttgtgaccagcttgctgaccgccagtcccctgtcatcgagttctgggagaacaaagtcttgaggctgtctgggggactggaggtgccaggggccctcaactgggaggtgaccctttgtctgctggcctgctgggtgctggtctacttctgtgtctgaaagggggtcaaatccatgggaaaggtaccactagaggcatgcaggggggagggtggctcagccctgggagctggatgtctgtgccaggcacacccgtggcaacgggaggtgaccagacagagtctagccctaaggaagggggaggtactgaaagccaagcaacactccccaccctgcaaatccagggcccagcagcctttgctcctgtggggagaggccccagcaggcactgtcccttccctgtgcccatcacccccaccggtgccctcctgccagtctctgactcttgtgacagtctgctggacctggtctggccatctgttacctgcctatcttgccttggggacacagagcagagtctggccacatcccttgggggctcctggtcaggctggggagtcacctgaacaaagaagacaatgtccagagctgtgggacatggccagctccctgggggacaaggtccccagagcagcatgtgggaagagggggcagacagtgtggcagccgcatcttgcctgcctctgcctggcccagttccactcttcacctgctcagccccgacctctctccagaagaggaggggggcccggccctgatccaatatcccgctccctgcctgggcctcccatgcgtgcactgcccacacactcacacagctctcactccccacatgctccatgcctcctgtccccactgaggagagctcccagaggctcgcccgctccccactgacatgcatccctgcagacaaacgaggcgcccagagagcttccccactgcacttgccagggctgccggggcccagccttgcccctagcttcctctggcgggagctatggctcggaggagaatggggacctctgaacatacctgcccgcaagggggaccggaggtgctcggagtgggcttgtgagggaggtggtgccgcagtccccgctgagcagcctggccccccagatcgtgtacttcactgctacattcccctacgtggtcctggtcgtgctgcttgtgcttggagtgctgctgcctggcgccctggacagcatcatttactatctcaagcctgactggtcaaagctggggtcccctcaggtgaggtggaggtggggaggctgcagcagggtgttgtgggggagccctgcaggcccctcatgcctgcactctccagccctcctctaggtatggatagatgtggggacccagattttcttttcttatgccattggcctgggggccctcacagccctgggcagctacaaccgcttcaacaacaactgctacaagacgccatcatcctggctgtcatcaacagtgggaccagcttctttgctggcttcgtggtcttctccatcctgggcttcatggctgcagagcagggcatgcacatctccaaggtggcagagtcagggtgggatgtatgtcttccagctgtttgactactactcagccagcggcaccaccctgctctggcaggccttttgggagtgcgtggtggtggcctgggtgtatggagctgaccgcttcacggacgacattgcctgtatgatcgggtaccgaccttgcccctggatgaaatggtgctggtccttcttcaccccgctggtttgcatgggcatcttcatcttcaacgttgtgtactacgagccgctggtctacaacaacaccaacgtgtacccgtggtggggtgaggccatgggctgggccttcgtgctgtcctccatgctgtgcatgccactgcacctcctgggctgcctcctcagggccaagggcaccatggctgagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtctgtggggcaagaggctgcaatattccatcctgggtgtctgggctgctaacctggcctgctcaggcttcccaccctgtgccctgggctgggcacagccccaggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgcgtgagggtggtgggcctgcggggacattcttactgtgctaaaaagccactgcaaacatagcaataaaaacctgtcattttcc

SEQ ID NO: 6105 - DNA, 1678 bp, Homo sapiens
cagcaaggaggcgaggagcggcggcggcgctgagccgggcccgggtgtgggggcgcctatatccccagcccaagctgcaggaagccgcgccgcttcctcggaggggctgggacggcggcggccacgtggggggcgggggcgacgctcggggcccgcggctggagggggagtcgctgcctcacccgcgcctggcgcccgcggctccctccgcctcgccggcgttggcccaccctctcgtagctcaccccgcgaggctggacagctcccggaaccccggaaccgggatctatttcgggggctcggctgcgtggcgcccaggactctccagggtctcccaggatcgctccccgaattcgagtcgccccctctctctttcgggaataccagctgatgtcagtccgccagccaaaaccagggaggagaagcgggagccagccctctggagtcgggagaaggaagaaggtgccacagctcttcaggaccacggttgggagaaagaatggaggggttttagaaccttcagtgtgcgacttcatgtgccagtcttcatctcaggatctcaagctcttggatcatgggcacggataacctgttgtcctcctctatggtcaagaggctgcttttgcaaagaatccagtgggagagagtcaatggcctgcttgacgtgaactccaaagtcctcctgatcagaataccaatttcttactgggtctggaaaggaggagagaaggatagagagtttcttctaggaccaaattgattcctccacaaataggaagatccccagactgtgtgcacacaccctcctcctccttccttctccaaccctggctggaccatgacatcacatggtggaggctgttttttaaaaagaactcaggccagatttacaagaatgatgctcaggcagcgtgactgtcaaggaccgtggccaagtgacccatagcacacacccagcagtgctgagaacatagctagtcccttagcacctggggctgactcatggttgctgtaggacccaatgccagatgccaggattgctttctccctccattcattaggactgtcccatgaaaccctccccaggaacccttctaccccatcccggcatgccaggagcctggatactgcataacacagggtactcatatttgtttaccaagccttgaagatgacaggcaatatgctgatatgctcaatgcatcatacaaattgttttatttaaaactgaactattaaattaagtatcatagcaactcactttacagacaaggaaactgaagctcaaaggttaagtaagggccaggcatggtggctcactcctgtaatcccagcagtttgggaggctgaggtgggaggaggattgcttaagcccgcgagttagagaccagcctggccaacatggtgaaacccgcctctactgaaaatacaaaaattagcagggcattgtggcacatgccaaggtgggcagatcacctgaggtcaggagttcgagaccagcctggccaacatggtgaaaccccatctctactaaaaatacaaaaattagctgggcgtggtggtgggcgcctgtagtcccagctactcaggaggctgaggcaggagaatcgcttgaacctgggaggtggaggttgcagtaagccaagatagtgccactgcactccagcctgggcgacag

SEQ ID NO: 6106 - DNA, 4025 bp, Homo sapiens
agactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttactgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcagcttactgcaacctccgcctcctgggttcaagcgattctcctgcctcagtgtcccaagtagctgggactacaggcgtgcaccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggataattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactgtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctg

SEQ ID NO: 6107 - DNA, 4486 bp, Homo sapiens
cttccggcgggggcggggaaagggcgcatttccaagggcccttctaggagaacagcgtgcggtctccatggtgccgggtcatccgagtcgggtcacgtggctggcgaaagccgtcgcggaggcgtggggaggagaaatgggcgggaggctgtggggatagcgagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattctgaattcttacaccaaaatagccccacatccaggcaaaaggggcctttcccttggcccagaagaaaaaggaacaagtggagtgcagaagaaaatctgtactgagagacttgggcctagcttgtcttccagtgagccaaccaaggctggtgctgtcccatccagtccctcgacgccagcaccacccagcgccaaacttgccgaggactcagctctgcagggtgtgccctctctggtggcaggtggaagtccacagactcttcagccggtatccagcagtcacgtggctaaagctcccagtctgaccttcgcttcccccgccagtcctgtctgcgcatcagacagcactctccatgggttagagagcaactctcccctttcaccactgtccgctaattatagctcacctttatgggctgcagagcacctctgccgcagcccagatatcttttcagagcagcggcagagcaaacataggcgctttcagaataccctagtagtcctacataaatctggtttgctggagatcactttgaaaaccaaggagttgattcgtcagaatcaggcaactcaggtagaactagaccagctaaaggagcaaacccagctgtttatagaagccaccaagagcagggcccctcaggcttgggccaagctgcaggcatctttaacacctgggtccagtaatacaggcagtgacctagaagcattctctgatcacccagccatatagcacagaggcatattttcctgttacttgagtggttcttttagctcatttgctgttacctactcctgtttcccaaagcttatgtaagagcttttccttctaaacttaaactgtgttgtggttcacttaggaagccacgtgccaatacctggctgctgtcttaactcgtagtctgggcacaggatacatatgtccccgtcccactgaggacctcagtttgggagtgcccttgagccccttttccttagcctgcaggtgcttcaatggatcatggggcaaagcaggagatgattgtgtggggctcttcctgctgtcacctcccatcatcccactctctcaccaggatcaagggtacagtaacacgaatgagcatacagagcaacacctgttgagccagggagtaggtgacacaaggaaaccttcatggatcttcccttgcctgtcttagtcacagagagaaataagaggaggttgtttgcatcccacaaggcatcgtactagttgggcgagacctaaaattccctgggcacaggttgcacctgggtgtgagcacttaatcactcaacgctttgttttcttacacttgaaaatcaagggaaagagtagtaccatctgactcctacactttcattacaagtcagatttttcttaaactagcaggcaaaaacagtacttccaaattttaaggtatggaatgaatgcagtacatctggaattgtagtcgatgaattgcttttttgacttagaagctgaagaaaatagacatagccggcatatctcatggtcaggagctggacgattctggtaacttaggctttttttctctcttcttttgaaacagtgtaacctgttttatgtctaaaaatcttaaggatagtttcagtggttcctgggatgtagtataagttaactctgctgccatcttgttttttttttttttcctttattttgataagtgattattatgcttgataaactttgaattaaatacagttgtcttgagggtatgataagtccacaaaaaattggaaagcatcttacccattttcttcacatcccaaatttttatttgttccatgtcatagtgatgggaagcagttacagagcagcgtcttctgtgtttccttcatgtgttagatattggcaacaaagccagaggtgtaatgttggttatatgaagttcatctcaaaatggagaccatgaccagagtttccagatgatacacgttcttttcagcttcattaaataggcaactatgtttctaaatagtaaagtttcaaaatattctctcaatttaaaatttcatcctcttgaaaatctttgttctttacaaaattatcttaataagttctatatggtcagcttcatcttccttttttttttttttgagatggagtttcgctcttgttgcccaggcggagtacaatggtgggatctcggctcactgcaacctccgcctcctgggttcaagtgattctcctgccacagcctcccaagtagctgggattacaggtgcctgccaccatgcccagctaatttttgtatttttagtagaaatggggttttaccgtgttggccaggctggtctcgaactcctgacctcagttgatccgcctgcctcagcctcccaaagtgctgggcttacaggcctgagccaccacgctcagctcagcttcaccctgtctgcaaagaaaagttttaccaagaccagaagttaaatatgacatttcctaggtagttgtaactctaacatagtttaaaaagtatgtggcttcagattgcctatactttgttcacaaacgtgtgatttagatatgactgatgtagaagtgaacaacttggtaacatccctagactccactcatgaacgcagaattattacctgctgtttgctttctgaaagaatttcagaaatcagagcaaatgtgtctttaggcagattcagctccttttaatatttttctcttggcccactctctttgcttcccctgaatctgtgtggtactatagcagctctactctgtgcaccatgctaggaagcttcctttttggcagaatatgtttggcagcaaagctatagagacaggtgcattcagaacatcctgggcaccagtcatgagtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaaccta

SEQ ID NO: 6108 - DNA, 312 bp, Homo sapiens
acatgtatttctttctttctctttttgaaaaagagtcttgctttgttgcccaggctggagtacagtggcaccatcttggctcactgcaacctctgccttctgggttcaagtaattctcatgcctcagcctcccaagtagctgggattacgggcatgtgccaccatgtctggctaatttttgtatttttagtagagacagggtttcaccatgttgcccaagctggacttgaactcctagtgtcaagcagttctcctgccttggcctcccaaagcactgagattacaggcatgagccaatgtgcctggccatta

SEQ ID NO: 6109 - DNA, 1019 bp, Homo sapiens
gatgcgaaacgccgcgcttgccggagatagcattgagggcccttccgcggcccggcgtttcgtctcttgggacgattttgtgcgttccctcggtccccgtggggcccatagtcctcacttctgccaccccagagtcgtcgcgcttcactagacccgctccctccactgtcccggaggcccacagacattcccgcattctgaggctcgctcccgtcccgtgccgctgttaccggcctccggccccggctcatacaagcaggagcacatcgctcttttatgaaagcccttcaacatttaacgtttaaatgcgagggccgacctgtgacagacctggttgggagtgcacgtcgactaggatcttcctcgcctcgggcttccttggagaggccgccggctggtctgagatttgggtccagttacagtaaatccagtcaacgcgagtgtgtcattccccagctatgcctgtctgcctggatgcagcctcgcggtggacagtgggctgatgttttgccgtgggagcgccacggacgggagagggagtgataatgattgtcaacctaataacaggctaactgaaaatgatatttatttgggaatagggcgttggcgaatatgcgtgccatagtaaacgatttgcgcattcaggaaagtaatggtttttaaagaaaaaatgaagaggaagataatggtttggaaataattaaccttggctacaaagaacagtaacaagtgtactcccggccgggcgcggtggctcacgcctgtaatcccagcactttgggaggccgaggcgggcggatcacgaggtcgggagatccagaccgtcctgcctaacccggtgaaaccccgtctctactaaaaatacaaaaaattagccgggcgtggtggcgggcgcctgtagtcccagctactcgggaggctgaggcaggagaatggcgtgaacccgggaggcggagcttgtagtgagccgagatcgcgccactgccctccagcctgggcgacagagccagactccgtct

SEQ ID NO: 6110 - DNA, 198 bp, Homo sapiens
actaggaacctctgggtttttttcttttttttttttgagacagagtcttgctctgtcgcccaggctggagtgcagtgggcacagtctcggctcactacagcgtctcccgggtgcaagcaattctcctgcctcagcctcctgagtagctgggattacaggcatgcaccaccacacccggctaattattgtatttttgta

SEQ ID NO: 6111 - DNA, 258 bp, Homo sapiens
gtgatctgcccaccttggcctcccaaagtgctgggattacaggcgaaataccaccttcacaatcacaaattttttgttttgagacggagtctcgctttgttgcccaggctggagtgcagtggcgcagtcttggctcactgcaacctctgcctcccaagttcaagcaattctcctgcctcagcctcccgagtagctgggattacaggctcatgccaccacacccggctaattttttgtatttttagtagagagggggtt

SEQ ID NO: 6112 - DNA, 249 bp, Homo sapiens
atctcggctcactgcaacctctgcctcccaggttcaagcgattcttctgcctcagcttcccgaatagctgggattacaggtgcccaccaccacacccggctaatttttgtatttttagtagagacggagtttcaccatgttggccaggctggtctcaaatggcctcaggtgatccacccgccttggcctcccaaatgctgggattataggcgtgagccaccacgcccggccctgtttttcaatttttta

SEQ ID NO: 6113 - DNA, 318 bp, Homo sapiens
ttgttgcccaggctggattgcagtggcacgatctcggctcactgcaacctccccaggttcaagagattctcttgcctcaggctcccgactgggattacaggggcgtaccaccacacctggataatttttgcatttttagtagagacagggtttcaccatgttggccaggctggtctcaaactcctgacctcagaacaactaggaaatacgaagtctcgctctcgtcccccaggttggagtgcaatggcgccatcttggctcactgcaagctccgcctcccgggttcacgtcattctcctgcctcagcctcccgagtag

SEQ ID NO: 6114 - DNA, 1637 bp, Homo sapiens
gaaacttacgccactatgaaacaatgcaatgttcatttttaaagtcttaatttcattattcagactaaatacacacaaatatgcaaataagcaatgtctgaggtataattttcaatatacataccattatctcttgtagaactttccaaatagtttaacatattgattctttttcagttcaaatggtcattatttgcttttaattaagggaaaacagacaagaagtgcaacctgaaaattcccacaatccaaactctcaggcacaaagtcaaatggctaattattaacagagctgggccaaacacatattttaaagtctaatgccattacctaaggggagggtattatgcacctaccaggggtcaggcaccgagccaggttggtagttacaaaattataaatatttatacttaaccaagttgccaataatggtttcaaaagattctagtaaaactctatcatccagaacagagatcttaacatgccacccgcagaaaagatgccacaacacaaatgcccgaggctaggcaggggactgcgagtacctggggggtagggacagcaggcggggacattcacgtgcaatgccaagttaaaaagcacccgccctgtgacgctccacagaactctcgttccgggctagtcctgcagccacacagaaaggctcactggaagatccaatttttttcttttggctaaagaaatagttttgctttcaaaggagctgagtgcctcaaagagctgtgatcctaaaaagtcatcaaatccatttggataaacggtcaaaagcaaaaaagaggtagctgttatttatatgagaattctaaaaccaaaccttttgtaaagtaaaatagttgtctcaaattatctgaatccacattttccacaaatactccaaacaataacttctaaattctgacttttgaaaatattcatttacctttcataaaatgtaattttaaaaaagaatggttagataaagcagtcttttgctctctagcctatgtggattaaaaataatcatccaaaatgtcttaggaacctccttagttaataatcgtaaaatctcgaaaagaaatctcaatacttgaaccagagtaattagatgaggaaatttttaaaaaggatcaagcaacttggccagccactcccccactggctccaagagctccatgtccaagtgctgtgctcagtctctgaatgtaccacacccctcagagggaagtgaaaatataacacaagactacttagaaaagaattggtacctacagagaaacacacaaaacactgaaatcaaaggacctggcggcaaagtcaacaacccacctcaccccagactcaccttccctggtgtggtaagtgaaccaccagagggagggagggtgccaaaggttctaaaacttgctccatcagcaaagaatttggtaaaagcaacaaaaagtctaacaataccaatgataagtattaagcacccaccaggggtcagactctggagctgggggagacgttttatcacatgactggcactaaaaggcagaaggtgtctaaactatctttggcttcccctttagaacccagtggagtgactgcagacagagtagatgctgcgtaagtctctaaacaaagtatccaaagtt

SEQ ID NO: 6115 - DNA, 3309 bp, Homo sapiens
agatcctcttgaggtctctgcctccagtgcctgagcagatgtccaaggccgggccagctccccagcccccatccagagccacgcagggccatttcccagccccaggccccaggccccaggcccccaggctgggttccctgtgcgtgggtgctagaggaggaaggctgcacatgcagggctttttctggcacagccagtgcttgacactgctaaagccctcctaatctgcgttattttcctctaatccctcccccaccaccctggcctgtgtgccacgctgcaggaccgttggtcccaacccggagcctgtgctgagccccaggcatgaggaagccacgcatctgctgcagcgtgcccgcatgaaggccaggacccggcccctccgtgccagccatgacatcgtgcccaccattacccagggcagccgagatggccacagaagcccagcccgggaccccaggacgacccctgcctgcagagacagcctccagaacgggcacacgagcgattcctccagcggagagtccagcggtgggcacaggccgaggcggggcccctcgccgtcgcacgtgcgctttgaggatgagtccgcccgcgaagccgagttccgtcacctggagcggctgcagcagcgccagcgccaggtgctgagcaccgtgttgcaggccgcggaccagggccccctgcgctccaagcccgacctcgccgactacatcaacggggctccccggctccgggacgcggggcaggggacattccacaggcttgtgggcagcctggaccgcaggggacacccggcaccgccggcaccgggcagcgagaggaggtgccaggcctgcggcagctgcatcgacgacccgcgccccgcccaggggaaggcgccccccgtccccaggaccctccaggagctccaggctgcctgtgggatggagagggtgctgggtggcctgagctccccactccggctccttcctgcagagccccggctccacatggaatggatccgggaaacacacatcggagacaccgtgtgccctgcggaggtggactctgccctggacagcacagacaactctgacaactgcaggaccgacagtgaggaggcggggacctctcaggctggctgggcgtgtgggcggacccaaggcagcagcccgcgactgcgactgcggggctccaggcctcgaggccacaggtggtccaagaaggctgaggcggagctcccttggggccttcaggcccagcaacacctgcctagggctgatgatgtggaggtggaaaatgaggtgaaagagggcagaggacacacgcctgaaggaactctatttttgagagaagatgccaagcctcctgacctggagttgaagcgggtgtccctgggaccccagtggcagcctggaccagggctgggaagtcaccagcctcaccctttggattcccggactccatgcaggacagcctatgccaccaccgcccccatgacgcctgaatcatcggggccaggaggccaggcccaggttacagaaagccacgagtccctggaaattgtctctccttcctccctgcaacagagccatgcagagccttctgccccacaccaagcctggcagccaacagcttccttgtgtcctgaaggctgggcgccaacccctcccccttcgaggaaaaccacctcgccagtgtctcacaggaaggcagccctggctggactgctcaggctgggtgaccagacagagcctgtgggtatccctcggcctccttcaagaagcgcggttctcaggacctgtgagctgcccccatcacagacccagcccagccgccctcaggtcaggcacccactgctggccctgtccaccaacaactgcaacaacagcgcacctcgggggctgcaggagccctacgggggagccgtccacgagggtagggtggagaggggcccctgcagccgggaaccggagccgcccctggagaacagcagagatggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaaggggaaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcaggtatgccctctcctcttcctcagccccatggctggggcggccttagcaaacaaggcagggccttctggctgtggtcagaggcttttctggtctttggctgagccgtgcagctctgggaattcagaaagcctctgactacaggactaggcttctcccctcaggggctctttctgaattgtccagggctctctaggagtctgcacctgcagagcctttgccctaggcaactgcagctgagagtgcgttggtggggagtgtgcgggagggggtagagttggcaggtttgactccactgtccccctgctgtctgatgacatcttgaaattagaagcttaggccgggcgcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatct

SEQ ID NO: 6116 - DNA, 9654 bp, Homo sapiens
cagcagctggcctgggagggagaaggggctggagagggcctggcctctccgagggatggaggggacagaggcggcggcggccaaacccgcgggcggcagcccccaagggcccaagacagggagtggaacagccagccccgtggaggggacctcagctgtggagtggagtggtcctgagccacagctggataacggacaccccccaagaccctggccttgccctcaggaaaacagaacatccagcctgatggccccccagcctcccagggtatggggagtacagctccagggcccctctgtgctggaatccaaggtgagggctttgaaggagaagatgacagtggccaaacagggagtgagtccctgctctgcttcccaagagtggtcatcccccaagaaaccccaatgcagacgaggcaaggcagggagagccgggactccatcagaggggtctttcctgccaggtgctgtggtggctcctcgtacccaaaacctgcctgatgggcagctggacggcagcatcaatgaggagcaacccgccagggatggaggccccaggcttcccaggccgcctgcccctggacgtgagtactgcaacagggggagcccgtggcctccagaagccgaatggacacttcctgaccatgacagaggtccgctgctggggcccagctctttgcaacagagcccgatccatggagttactcccggacggcctgggggtcctggtcattgtaacaaaatcatccacattcccagcccaaggacaggaaggtcctacccttttccagatggcgtggtgacagaggcagatctggatagcacatccctgacctccgaggaggtctttgtccccaggacggccctgctgggtgagcgctggagagctggagacctggaggctctgggcgctgggagcagtgtcttgtccctgtctgatcgggtggagagaaaccgcctgttgctgcaggagatgctcaacgtttctgggcagagcccccgcaaggtgggaacccctgcctggactccatcctgggacacagctgcaccagagcgaccagtgggggatgtggactgggcctcgggcacctccttgcaggactccggccagaacaggaccgttggtcccaacccggagcctgtgctgagccccaggcatgaggaagccacgcatctgctgcagcgtgcccgcatgaaggccaggacccggcccctccgtgccagccatgacatcgtgcccaccattacccagggcagccgagatggccacagaagcccagcccgggaccccaggacgacccctgcctgcagagacagcctccagaacgggcacacgagcgattcctccagcggagagtccagcggtgggcacaggccgaggcggggcccctcgccgtcgcacgtgcgctttgaggatgagtccgcccgcgaagccgagttccgtcacctggagcggctgcagcagcgccagcgccaggtgctgagcaccgtgttgcaggccgcggaccagggccccctgcgctccaagcccgacctcgccgactacatcaacggggctccccggctccgggacgcggggcaggggacattccacaggcttgtgggcagcctggaccgcaggggacacccggcaccgccggcaccgggcagcgagaggaggtgccaggcctgcggcagctgcatcgacgacccgcgccccgcccaggggaaggcgccccccgtccccaggaccctccaggagctccaggctgcctgtgggatggagagggtgctgggtggcctgagctccccactccggctccttcctgcagagccccggctccacatggaatggatccgggaaacacacatcggagacaccgtgtgccctgcggaggtggactctgccctggacagcacagacaactctgacaactgcaggaccgacagtgaggaggcggggacctctcaggctggctgggcgtgtgggcggacccaaggcagcagcccgcgactgcgactgcggggctccaggcctcgaggccacaggtggtccaagaaggctgaggcggagctcccttggggccttcaggcccagcaacacctgcctagggctgatgatgtggaggtggaaaatgaggtgaaagagggcagaggacacacgcctgaaggaactctatttttgagagaagatgccaagcctcctgacctggagttgaagcgggtgtccctgggaccccagtggcagcctggaccagggctgggaagtcaccagcctcaccctttggattcccggactccatgcaggacagcctatgccaccaccgcccccatgacgcctgaatcatcggggccaggaggccaggcccaggttacagaaagccacgagtccctggaaattgtctctccttcctccctgcaacagagccatgcagagccttctgccccacaccaagcctggcagccaacagcttccttgtgtcctgaaggctgggcgccaacccctcccccttcgaggaaaaccacctcgccagtgtctcacaggaaggcagccctggctggactgctcaggctgggtgaccagacagagcctgtgggtatccctcggcctccttcaagaagcgcggttctcaggacctgtgagctgcccccatcacagacccagcccagccgccctcaggtcaggcacccactgctggccctgtccaccaacaactgcaacaacagcgcacctcgggggctgcaggagccctacgggggagccgtccacgagggtagggtggagaggggcccctgcagccgggaaccggagccgcccctggagaacagcagagatggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaaggggaaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcaggtatgccctctcctcttcctcagccccatggctggggcggccttagcaaacaaggcagggccttctggctgtggtcagaggcttttctggtctttggctgagccgtgcagctctgggaattcagaaagcctctgactacaggactaggcttctcccctcaggggctctttctgaattgtccagggctctctaggagtctgcacctgcagagcctttgccctaggcaactgcagctgagagtgcgttggtggggagtgtgcgggagggggtagagttggcaggtttgactccactgtccccctgctgtctgatgacatcttgaaattagaagcttaggccgggcgcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatctcaaaggaaaaaaaaaaagaaataaataaattagaattttgaaggccatctttgcagaggagagccagagggaaactgtctgtgcctgctggttctcagcagtccctttgatgtggctgcgttgaaacggttcctttcctccggctgtggagtatgtctgggcacgtggagcatgcctgtctgtctctgcatcccgtccctccctcaggcctgtgcccgatgattatgttcagatgaatcctggctgcaggcctctgactggggtgtgctctgggtctcaattcaacccaggcaatggcagggagaagtcctggacatcattctgcactctgaccagttctcagttccaccccatccatgagtctttcagggcaacgtgacttgcaaaagcccacgcccaaggtctgtggtccagaatgcatctcaagggcccataaaagacattccccagaggatcagggaaggaagacacgtatgtgagggtggggaaggaggggaggggaaggaaggagagagaaagggagagacagatacagaaagacgaacacagaagcctgctgcggccgggctctgccgatggggggttgagtcctgtgctttgatctcctagctcaatgctgtttagcctggaaaaaagtctgcctgctaccacatttgcagaccacagcatgagttctcatgtctgttccatcattgtttcagcaaatatatactaagcacctactatgtgttatagatacgggggatacagcagtaaatggaacagaccaaatccctatcctcatgaatatactacccagtgagcagttagattgtatctataaaatgtgtactcttgttatgtataatgtgctacgtatgtcagatggtgaaaagaaagttctgagaaacagacagataaagcaggtgtggcaggtgctggtatagacaggagtgtggggaggcttttctgagaagatgacacttgagcagggccgtggatggggcgaggaaggggccccatgggtgtctggggaagagcattccggcagactgaacagcaagtgcggagccctggtggaggggcgagcctggcctgtgagaactgtgagggtcaggctggacactgcagagcaggcaacgggttgggaggagcagagtttggaaagatggggttgtgccactgtaaggggctttggctttcatgccgaatgagatgggagccactagagggctcggagcgagcactgagactctctaatgtctatgagaatagaccccagtgggacacgggtggagccagggagccctgtgttgaagctatttcagcagtccaggacagagacagtggtgcctggactgggaacggctgtggagatggggagaggggagaggggacaggggttggattctggttgatttgactatttgctgatgagctggacatgtaagaggaagagaggacaggtctctgcctactctggacctcaggaggataaaaagtccttcctcacaggccttcccgtagcctcctctcccgttaggggagcaggacaggccccccggacaggtggtgtgaaggcagaggcagacaacgcagcatgtttgtgctccggcacctctgctggctatgtgatctagagcaggcgacatccccactgagcctcactcagttccctaatctgtgaaatgaggatgacaaaacctacctagaagagtcataaggagcatttggtaaggcacacaggaaagggcctagcatttttcttccctccccttcagaaagagaaagtctggggaagagaaccccagacagggaccagcgtgatccgcattcacctgtcgatgtgagtgcacacacaacaggtcattgtactctgccgcccaccctcccccagagtccctttttgctcccttgtaggcagtgggagcccctccctgtcacccgtcagggagctctgatgggcaggggtctctagtgacccagggcccccggcaccctcgcctgagttggtgccagctccccgttgtgcccaggcactccctggtcctgctgccatcatgggcgctggatggcacacaggggtccccacgcacatgaagcctggcgagtgctggggcctccgtgtcccaggccatcctccaacagcagagggtcgcttcttccaggctccaaggggctgtgaggagggctggcttgcgccccgcactgaaccggcaggatgctggtattaacttgctggctttcacatccgactctatatgagcctgtgagaacagcaggctttgccttctgcttctaattggatacaacatagagatcacacatcctcaacaaaggccatttccagcagacaataaatgcctatgacagcaggctgtcatatttgtgtcacgaatttcagttgcgaaacctacccgagtctccccaaaatggcaggcgtgacgtcagtgtctggcctagctctggcagcattctttcagggtttatcattagtccccacctgcaactcccacagcacatcagacacttctctgggtttgccccaggggccccttcttacctgccccctccccgtgccaccaacccgtagacagggagggcaagcagtgaaaggtccatctagaggaggtaaaagacagggctgagggaaaacgccttgtacagtcaggatggcagatgtactctgtcagggaagacagccccacagaaaaggctcggcttggccaagaagcaacaaaagggattctacacctcagaccagggagggggaatgtgtacaaagattggatttactaaattcagagccacagactttcaggtacttcggtgaagatcagtgctctttcaaacccacacttcagaggcaggctttaaaacgcctgacttctgtcagggccacaggctgggctgcccaaagctcctacggggctgggggatccgagagaggacttcccactagtccaagatgtggtgactagtttcaagccagagattgaggagcagacctgatgccctttcgggcccctgctaagaacctgattcgaggaaaaggaagtgaagacagtaacgcgtgggcagtggcctcatgtctgaaatgcagagtgagccgagctgggctgcgaacagcgagggtgccaaaggctgcgctgagcagcctgaattccgccagtgctgatgcccacaccaggggtgtgccccgcagtccctccagcaaactcagcttgtgtctcagcccctgtgtccacccagcatgaagcatgggcatcagggggtccagcctgccctgggagagccagcacctcacttactctcccaggtgggagcagctggaggggaatttgaaaggtttccagccgcggttgaggccggcgggcgggggttgggggcagggggcctcctcagctggacacttcccagcccagccagcccaagccccacagggcctgccccactgacggggggctccctgagagccggagcctggcaaagaagcagagaagctagttcccgcaggctggctcttggcaccttctagacccaggcagggcctctttggggtggggaggagggggcatgtgcagaagaggagagggagccaccgcagctttgaaatatgtggctagaatttttatttttcctggggttttttgctcagatgcttccccatcccaattgaggagccatatctgagtaagactgaggccagtgtcagtctttggcaatagagtgcagcaaaccaggcttggatgtggctcagccacttttgctcttccgatgataccttcccaccaccccggcctttacgctgggcctgggtgacctgaggcagcaactggatcatagtgccaggcactgagtaggtatggttcctaatttttaaaaactattttcctcccaattctacaagaaaagctcatctcagaaaaagattagctcactcactgtcaggtataaataaatgacaacagtttaacgcgttatttgcactaggagcatttccactttaaaagcagagacagtggaatggagttagaccatggaggaggcgcactgtatctatgtctaaagccagttgtggttgtgagatggaataatgaggggtgtgtgtatgtgtgcatgcgcacagagaagtgcctggtatgagcacctcctccctgtgccacacaaacagcacctcatcaacatggtcagcattccagagatgcacttcttcgatttgggtgtcattgtgaaattctcctgttttcctctgcagggatctacgtgcaggagatggctgacatgagcatggccaagctgtactcagggctgctgggggtgggcgatgagatcctcgaggtgaacggggccaaggtggcagggctgggcttggctcacattaaggagctcctggcccactcagagagcttgtcaatccgtgtcctgaggcagagacctgtcccacggtgacccagaagtgccgctgccctcactgtcacggcctcggaagccctgaagcactcagggtggttggcaggaacgtgctgcacagagctgctctgtggcggaaacagatcctggcagcatctaaccccttgggctgtggcagggcttctgtggtgggctgcctttgggagacgcaaggagcctgtttgcatattttgtttaaggccatttatccagaactagaaaaagaaaaaaatgggtctccttccatgtctgagggggtgtcaacatctacttgtacctttgttggcagggggagaagggagattcagtggatcctttggttgatgcctgagagccggcctcacctcctggtcccatgcctggtcaaaggctacagcctccaacactgtggaaccaaagaaagcacatgtccatattggccttgacccttccctatttcagccacgttcctccctactccattcactgcccttgccctttatccagaaatgggcaaagtgtcccggaataccagccttacagccattgaccatatatgccaaaccaaaatcagaacgtgtggtctggcaggagttttatgccccttcggggtgtgggaattctgggagatgttatctggtagccagaatattaaaaatttctaggaaaatttttttatacataaagttgaaaacaacaacaacaacaacaaagaccaatttcaggacgtgctactgtggtagccaggatccagctagtgggaccggccagaccagccccatgccaccccggccgctgcctctgcccaggtggaggcaagagttgctgcaacctgacctgtggcagcctccatcttagttctgtccagcttggagacagggctgcggcaggtgcctggccatcacagctgcatgctttctgcccagacctcctggcggtgctgtcggtgggcaggtgggtgggtgggcagcagggaagctgcagagcgcggctgggccatctgcctgggcctcagtgctgcctggagggctgggactctttgggagtggatggccatgtgtcagtcttaacttactaaaaagcaaagctaaagcttctctca

SEQ ID NO: 6117 - DNA, 2113 bp, Homo sapiens
ctcctcctggggaaaaggcttttcacggagcaggctcggagcctacggggctggcctcggactggatggggagggtgctcaacttgctggagtcatctctgctatggctttatttgccaacaacagagaacttgctctgcagcagccccaggctctctggggaccccacaggctatgcagatcccccaccccagaaccacagaaggagacagagcagaagcacaccccgtcttccaggcccaggacagctgctgagctccaggacacggactcttgaaggttgattttgactacttactaagctccagctgaaccagttccacttctttaaccttcccatgatccctgtgaggggtctgtggtattgctatttgcaagtaaagaaagtgagattgagggaggctgaaagacttggccccaagtcacaatgccctgctgaatgtggtgctgcctcctggatatcctgggtgcttcaacatcaacagctcttggcaagtgagtgggccacgaaggatggacgagggacatgggggagcaagcccagctgcacggttccagctctttccgccacatcacagcttctgcagttgggaagactgaacagtgatcttcagtttgttcgtcaaagggccaagaaatctgtgtcctcaccttctctgcttcaattctggtgctgcttaagccgattatcatttcatgccctaaaccaaaaaataaactctacaaacatcaacattacataggacaggatctggcccacagattgggggcaggagctgctttttcaatgagaagaatgaacagacctagtgggcgttgcctttagacccaggtaagaggaatcccagccttgggacattactttcaagggccaagcccataggccatccttctagaacattctttgggtagctagggcttcataagtcacttactgggtttgtcctccttgagtggactgtgttgtcggtgtgcacacctgtatttccatggaatggtatcttagtcctgctgctataacaatacctgagactgaaaaatgtataaacaatagacatttatttctcacagttctggaggctgggaaatccaagatcaaggcaccagctggtttggtgtctggcgagggctgctctctgcttccaaaatggtgccttggggctgggcgtgatggctcatacctataatcccagcactttgggaggccaaggcgggcagatcacctgaggtcaggaggttaagaccagcctggccaacatggtgaaaaccccatccctactaaaaatacaaaaaattagccaggcatggtgatgcatgcctgtaattccagctacttgggaggctgaggcaagagaattgcttgaacccaggaggcagaatttgcagtgagccgagattgcaccactgcactccagcctgagtgatagagcgagactctgtctcaaaagacaaacaaaaaaccaaaatggtgcctcattgctggatcttccaaaagggatgaacgtatgttctcgaatgacagaaaagacagaagggcagaaagtgtccaaactcactccatcaatcccttttataaggtgctaatcactccctaaacaccccatctcttattactgttgcactggggattcagtttcagcatgagttttggagggatacagacattcaaaccacagcattgtgcacactcctttttctatggaatggccaaggtgcagctatttgcagaggctctgacagagctccgctgtggagctggggtgtccacatgcctgtatggaagaactttcatggcaccggagcctggtgggaagagaagtgggctgggctatagactgggcaccagggactatcacctcgtgccaccacatttagtgtagagttccagagaggccacaaattcttcatttgaactggactccccagcctcatgttcctctgcaggatgtaaaaggtaatgccagcagacgttggcagtgctggagacacctggtgggcagaggttacctggctggagtggcaggtgtgaggagatgcctcccagcataaggaatgtgggcttctgttggatctcttgttccaggcctcacacatgttcaaggcagcctgggta

SEQ ID NO: 6118 - DNA, 1155 bp, Homo sapiens
atgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctag

SEQ ID NO: 6119 - DNA, 4499 bp, Homo sapiens
cgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacatggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttctttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 6120 - DNA, 2947 bp, Homo sapiens
ggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatgattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattctg

SEQ ID NO: 6121 - DNA, 1789 bp, Homo sapiens
cacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacagatatcatttgaggatgtggctgtggatttcacgctggaggaatggcagctacttaatcctactcagaagaacttgtacagagatgtgatgttggagaactatagcaatctggttttcttggaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaatt

SEQ ID NO: 6122 - DNA, 4556 bp, Homo sapiens
cgtctcagcttcaagaaaaatgtattgcatttattgtagacaacttctccaagattattcagagtgaaaattttgctcttcttttacagtcacaagcaatgagcagcacagccgatctgttggacacaattttaaaagcaattgaagaaaatatcaccactgaaaatagctgctctcttcttatggctctggacacactgctgaactctgacagtacaaaggaaatgggttttacgtgcaagatccaggctctgcgtgataagctgtggatcttcctggttcagtctttctatgctgttcgtcacacagaaagctggaagctgatgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaagaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtaataatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaactaaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcgcctcaaggcgagtggacaattctggaactggaaactcagcattaagtgttaacattttggaaaaatttatgccactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtcca

SEQ ID NO: 6123 - DNA, 2933 bp, Homo sapiens
gagaaagaggctccggggagatagcggaccagtgagggctgcccctcttttgaagcggttttcgtctctttccgccagtggcctcccagctcacgcaggggcgggtcccggtagcgcgaggcggtgcagggcgggaaggggagtggtggcggctgcggcagtagggacagcaggagcagtggtgctgtcagcgcggccgtcggagacatgggagacccggggtcggaaataatagaatctgtccctccagctggccctgaggcatctgagtcaacaacggatgaaaatgaagacgacattcagtttgtcagtgaaggaccatcgagacctgttcttgaatacatcgatctggtctgtggtgatgatgaaaaccctagcgcctattatagtgatattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtcttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaa

SEQ ID NO: 6124 - DNA, 3210 bp, Homo sapiens
taggacctccatcagcagctaggatctccctcagcacctaggacctccatcagcagctaggacctccatcggcacctaggacctccatcggcagctaggacctccatcggcagctaggacctccatcggcagcgaagacctccatcagcaaaggctgggtctagacccccatgggctccagattccacccaactcccagccatctgcccagaccgacccacacccacctcctgcagatgccctgggcattactgaacccctatttcctgaagccagccagcgagtgggagcaccggccagcatggtcctccctggccccagggatctcccagccctgggacatgggacccctgggcagactgccttcccccagcttgtgcaggctggcaccaggcacagaagcccagcacagggcctcttatcagcccctccatctcttccccagaacaggcccagcctgcttgcccagcctgtcaccatgcctggcagggatggcatcacccagccggctgtgtgcaactgctgaaaccccgtgggccctgcttccagtgccgcaccctcctcgcccaggatggctgcaggatttaccaggtcctccgcacagtgaaaatgtgagctccttgccccaagatgatgaagaatttcaagacggcaatggtagattggtaaattaacctcaggtgccatgtgacagcacaggttgggtgctgtgagccatgcatgaagctcctggtgggtacagctctgcctcatgggtcacccctctctaccgtgaccacgaggactgggctgggtatgcagtgccctgctgtgacccctgacacacagacccctagccatcccctccaccccctccctgacctcctctcccagggatgcaactgggggagcacacccatccccagaagaaccccaaatctctggctggctgtctcttacccaacccccatccccagctccagctgaggggcaagcgtgctgctgggctgctcctgaggagaaacccatggcgccaccctcaggcccccggtggctcctcaacctgggccccatctctgccccccatcttggctcctcaggcatatttaaactttgcccctcccacccccgtgcctggcggatcccctggcactgaggcccagccagtggctccagccaacgcacttggctcccgcagcaagttaaatctaacccagcccagctgtctctcctccggctcccacctgcccctcccgttccctgcagggatgtgcccacaccctgccaaccctacatgggccctcaggaagggtgcagaggtcccccagggtcccccactttcccacactaggaaagccctttgcctagcagcctctggggtgggtgccctgcttctggaggtaccccggcacccagggtggggccagcagagtgcagcaggttttcaacaggtatttcaagaaggagcaggaacccacttcccatcagtcagggtgcagccaggaagagggaaactccagggccaacgctgaagtggccgctgcagcaccacgctggggcacggagttggagtacagcccttgtgccacaggcgtgccagggaatgtgtgccaggcgctctgtcttgcatctggggctgtcggttcttctgaggcagggcactcatgggtcgcttctggagatgtccacatttctgggtctgggactgtctaggcctggctttggggccatctgtaatctgctccccgtagccccatgttttgtttaggctggaagtgcactcagctaaaatgccgttatcctaccaaaagtggcataggatggagttctggccagtgagatgtgagcagaagtgctgggtgtgtcttcagggacagatcctcaaagggagctgactcatctagggggcagcacttttgctcttcctcttttccttcctcctttctggtcaggtatgcttgtgatggctggagcatcagcagctgttttgggccatgaggtgacactgaggctggaagccagcactaggagagtgatacagtaagcagagaagccagggctgtcacgtcgcagaggagactggagagctgcggcggggaggggtcagctgcggccacgtgagggccaggcccctctctgactgcccaggctgcatccacacagaagattccatggctttccataaaagagagtgggagaatgtcctctctaaaggcctggggagtgcctggggagaggagacagcctcagctggggctcaccagccagcagctgccagccaggccagcaatgccaaggcacccggcgttcctggaagccaagccctgtttgatctaatggggcagctgtgggtgcagacccagataaagagataaacccagacccagaaacctgggggaggaggtgggagcaacaacctctcttccgcctccttcaccgtgagaggaaaggaagcgggatgacatagttgtggctgggactgctggaccccgcatgccagccctgggaggtatgtgggtcatgaaatccacccactggtgacctcccccatggtgagggagggagagagcttctcccctccttggctaagaggacagagggaggatcctacaaattctgtcaggaagcagaaatttggtctgagagcagtgaaggtgggagcagacaccccccaaatcacctgcaggatgagcatttctcaggctctagagagcatgtgtgggacacagccgccagcccacctggtgcgggggtccagcagccacagccatgggaactcctgggcctgttgttcgtgtgcggatcctggtccgggagcctggatgcggctctgccttgccgacaagctcctgggccaggcctggtccaccagacctccctatgcttggagtgcctgcttgttgtgcctggagctgtgctgggcccttcctcattgcagggctgggggagtcacttaacctgtctggggctcagtcttctcatctgtaaagtgggaatgatggcacctggtacccacttgattggctgttgcaaacatgaaaccagatgggcctgtaaatcacagggcactcggccgccatcaccatcatcatcatcaacatcatcatcctcatcatcatggccccagctcatccatctttgttgccttctccacccccatcttccatccttggagaactgtgcctcttgaattggcctcgtgacctagtaaagatcataacaaagacgcct

SEQ ID NO: 6125 - DNA, 5767 bp, Homo sapiens
cgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcttgctccggaggtccgaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactaagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 6126 - DNA, 552 bp, Homo sapiens
tgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggctacctgtaccgccgggacactgaccacacccgcaagcgctttgatgtgcctcctgccaacttggtcttgtggcgctcctaggcctgagccaaacggaagcccccgacccttcaccctcacccctgtgacctcaggtccccaaggggaagggctgctcactgcaggaggagtgacctatattcgggctaagacagctgtgccatgcccacctattgacaatgataaagggaggtctctcttctcagcagca

SEQ ID NO: 6127 - DNA, 1834 bp, Homo sapiens
ggagagcccggcccgcgggccgtccgtcccccacaggaaaccgccggggaggccgcggcagggacccgcccccaggccactaacagcaacaacagagaggctggagctctgcctgcgtgcgggccaagggctaaaccttggacaggttctttcacttactccgcctgacaaccctgcgacgtgataccattatccccacttcgcagatcaaataaacggagtcttggagagattgaattgactttaccaaaaccgtcaggatttgaatctgctgctctctgatcctaaagcctgagctagaaaccaccgctccccctcctaggaggccccttccaggggcttgccgtggccaagccaggccaggtgggagaagcggcagccttgccctggagggttttgagaagcactgctcctggaggccctggggaaggtccctgaaacctttggccaatgtggctgtccccatggtccacatgccctccccaccccctgcctagctgcttgactgcctgctgctccccagcccaccagcctgtccgtgggtcagcccagccacccgcttcggatctctgcacgtgtgtcacctgctgttctggccctcatcccaactatccacctgcccatctcctccctacctcctcgctgcctatctgcccaggacttatctgctgtctgctcacctgcctgcttgttgactgcttctctgccctcctatctgcctgtgagactagagatttgtcaccttggaaagcacggagagtactgctaagatgaaacacaggaaggacaggccttgatggaaggttggggggccgagagatccagagcctatgggaggggacttgtgagtgctggcatattcaggacccagtgcaaacccaagcacagctctgctcccggccccagtggccaaactgaaggcttgccctggctattctgccgttgacatgggcctcaccctaccacggggataggtcttggatggagggaagagggagactcaccgggggcctcctgagtcctttgagtgtccccatgaccccagcacctgggacagctgctggaaagagggtactggcaaaaatttgctaaatggacaatcataggcccagtgtggtggctcacgtctgtaatcccagcactttgggaggccgaggtgtgcagatcactgaagtccaggagtttgagaccagcctgggcaacatggcgaaaccccatttctacagaaaactacaaaaattagctggacacggtagcacacacctatagttcctgctactcaggaggctaaggtgggaggatcgcttgagcccaggagatcaaggctatggtgagccgtgatcgtgccactgtactccagcctggatgacagaggaagaccctgtctcaaaacaaacaaaacaacagcaacaacaagaaaacaataatagggacattgagtaccctttctggcacctggcactctgccaaatgctatgcacactccgcccttcagtcttcccaggaaccctgtgcagtttgtagcgtggctcacatttgccaagaaggaagtgaggctcagcgaggttaagcagtgcctgtggagtcacatggctgcaagtagtggcctggactggactgcagagcccatgctccccaccgctttccatggggcaactctaggccatcattctccacccctcagacccaaagctgccttttcataatgcttgctgttgctccctttatgctcctgaaatgaaatttatggctaatatgccagcctttacatctaattaaaaatcatccaatggtttttttgtccttattaatatataagaaataaaaggtaatg

SEQ ID NO: 6128 - DNA, 4483 bp, Homo sapiens
gcaggtcccgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtctggggtcctgaggctgctggcagactatgggtacaacggccagcacagcccagcagacggtctcggcaggcaccccatttgagggcctacagggcagtggcacgatggacagtcggcactccgtcagcatccactccttccagagcactagcttgcataacagcaaggccaagtccatcatccccaacaaggtggcccctgttgtgatcacgtacaactgcaaggaggagttccagatccatgatgagctgctcaaggctcattacacgttgggccggctctcggacaacacccctgagcactacctggtgcaaggccgctacttcctggtgcgggatgtcactgagaagatggatgtgctgggcaccgtgggaagctgtggggcccccaacttccggcaggtgcagggtgggctcactgtgttcggcatgggacagcccagcctctcagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaagtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaagaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttgttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgattttttttttttttgtacagagcttttaagcattaaaaacagctaaatgtg

SEQ ID NO: 6129 - DNA, 6295 bp, Homo sapiens
gtctggtggcccgacccgcgccgcccgcggctcccttatgtctctcgccgtctccagcctcagtccctctctgtctctctctcagtctctctccctgtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagcaaattttcttttttttaatttttaaaacttcattgtattttatgtttagagatggggcctcactacattgcccaggctggtctcaaactcctgggctcaagtgatcctcttgccttggcctgccaaagtgctgggattgccttttccgcccaccccccccgaccccaccagagacagggtctcactctggtgtccaggctggagtgcagtggtgcaatcatagccttaaattcctgggttcaaccaatcctcccacctcagcctcctaagtagctgggactacagttatgcaccaccatgctcagcttattatttatttattttttgtagacatggggtcttgctatgttgcccaggcaggctgatctcaagctcaagtgatcctctggactcagcctcccaaagtgctgggattatacgtatgagccactgtgccccaccctcatacaaatttccatgttggcaactgtagctggatctttctggagatctctgaaagacagcatggaatccttgaacaccccctgaggcgtgaggcatccagagcatttatctgccaaccctcaggagctggcactcgtagacagcacgcacagccagctccattggtcttggcaaagagaattgcctcctggagccagaggccggttcctgtgcttagaaaggaaggacatgtcttctgtgctccctgtctcacaaggcctcttcagcaggcatgggaccttcattctcaagttcaaggaaccctgtggaaccttgtccttgtcctccagagagaatcctctccgccttagaggtccctcctctctctcacctccccaccaagcctccctgaactcaatgtcttctgtccccttccctgcccaacttccacttctctatgcccagcctctgtggcccagtaccattggggttctgtgggcagctgggtcctggtggttggggaccgtgggaaggggcctatctgtcggatcttagatggagcatccagaagccccacccttcatactggccagagtggcccctgccagcgcctctctggagtgtcattaagctgaaagtgtttgccttacctctgcagtaggatgcattactgaagtggcctcttggtcacctagctctgaattttcctggctccagaaagaggctgtggggcacaggtcccccacaatgaggctgtgaaggggagagaggcaggcctgggccaggcacaggaggacaactagggcttctcaggagctgtctcagccaagagtcacacacttgatacctaaaatggcttcaggaatcttccaagactgaagacttccccaggtgtggtctagggcctgcctgcctcagagccatgagcagagccggtcaaaaggcttcctagggaatcctaccccagacattaaaatagactcttggtgctggcaggtggctggaatctgcgtttgtagccaagtgctcttcctgtgtgactcagcaaagtgggggtgcatttggggaacacccggggctggggcctgagtcctccacccaaagccaggtttgattcttgcattcccctccctgccttccatccagacaggcccaaagatgcaagaggcgttgatcagcccatctccatccatgcctgttgcctcagagagggccgacggcttttaaaatgctgttgccatagcaacagcatccagccagtgggtaccacaggcagggagccacagaaactggggtgctgggatggaaactgacttgtgagagaccacagctactgctagaaggaaggggggcaaagcgggcacaggtaatctaagaatacttgggcgggaggagtccccaaggttaccttgtgcatccctctgtccccagaaagaactgtaccccaacaatctctcccctcactgcatcccctggggaagaagggaatgcagaaatgaaatgtcataatgagtaacaatgtataaaaatatcgaataataacagct

SEQ ID NO: 6130 - DNA, 3815 bp, Homo sapiens
agttagcccagggaggaaggggacagaatgacagcatggttatatcaatggtccaattcttggttccaacccttgattgtccttcgagagcaccacccattccttacaacacatctctccgcttcattttgggagttttgaagttattaaagttattgatttcttttccttacaaccaaaataatctaaattaagattgtggccaagtttggattaaaacctgcctcccggctccaagacccatgtttttctatcatgctgactggcagcaaagacgtcttcccatggatttttcagaactctgttctttaaatgtgaccttagatgcaccagactcatgccatccaaaggttggaggtactgcccagttttagcaatgaaagtcccacgtcacgggaaacctctgagtcctggacaaatcaagatgacattttctatgcatatgcaagcatgtcaccaggagcagagcacagagggacaacacagcttttgcgcttccagctggctcccatcaagaagttagaagggagcctgcaaacacatttcctgctatcatctctccaccccagaatgactttccctggtagagctgggggaggggaggcgggcagcaggccccccaggaggccctgggcaggaatattaatactccaacttcccagcacaagaggagggaggaggagcggccacggcgcagtccggtcctgggggccctggaaggtggttgctgagcagcccgtgggaggcacggatccgccagctcacggcggcaggggccgcccaagtcctaatgaaaacacctagctcctggcagggcgcagccgacacatcgccctgccttctcggccacctgggagaggatgggcgccgcacgcggatacccaacctgccgggttgtgctcgcagtgacatcgcttttctcccggcaagtgcatccatctcgctgggtctggatagataacacaatctctctgcccacaccccatttgctgggagacagcctgggcttctccattttttatgggctcacttagcttggaggaaatccagaggtcaaagccggcgcagacgctccagtcaccttgcccgtccgggcgcgcagccattccgaaacgggctcacccacggggccctaaattacggcgattacactgcaattcgcagcgcgatattactttgatacactacctgctgcagcttggcccgggaggcgtgcattatttaccagggaggctgtccgtactgcgcaccagagctgacagcgctccgcggggtccctcctgtccctacagccccgccttcgcccgcggtgcggggtctggaggcagtggggcgggggcagggggtcactggagcagccccgctctctcggagtgaccgtttcctgaacgcaatatagcccggagaggacccagtggcggaagcggcagctggcgatgaggttgggggttagtaggtgggaacaagtgctgagcccgcagctcctcctggctcttaaggacacccagaccctccttagccggcctataagggcccttgttgcgcgcgcgcagggacccacacagggcctgcccaggggtgcaaggctggtccctggcccctggccaactgttaaaacggctagcagccggctaaccccaccggcaggctccaggatttagcctgtggcggctggtggcggagatggagggaactcaggctaccctcttcctcgggccctggaagctgcgtgcgcctcagctgaggcctgatttcgccgtggctgggggctggggccggagttgggcccggcttctctccggctcccccattacggtttggcatcagcatctagattgcaggttacttctgcttttatccaaagcggtccttaagggagatggagttctgattgaaatccagtcaattggcgccgtggctcagagggcccagcgtgagcacacttgtagggaaattgccctgggtctgagaggaggggcaggggtgggggagggaacaggacccgcaggcctgctctggagcctgtgaacgcgctgctgcgaggactttagcggatgcgctcaggtcggtatccgcgggagtcctggagggaaatccgctctccttctccagctccctgggattgatggaaccagaaacctcaagcaagggatccccagaggtcactgcgtccagtctccagcctcagacagtgtctgggtagtggaggaggggccgagtctgtgggaccgagctgtctgctttggtgggtgaaggagggtggacttctggggtctgggttgagatgtggattagttccaggactagttcctgttactcgtaggcggggagaggtcatggtccctgctgaacacatctggctgtgttcagtcctgaactgccctgggctcctcagcagtgtgcacaggggtctggcctccaaatttcttgttaacagcccatcaggagctggaggagctggcctggccttcaaggtgtggaggggttcctggaaggaagcagatgggcacacggaggagaagaatgacaaatccatgcttccccaatgctggggagagaatatggtggtggggaggaagcatggagaccagaagcattcccgggaatgcttctggaagtatcccagaaatgtcaagagctcattctgccagctcttccggggccagcaaagaacatacatatcatttctccatccactttgggacctgcctgagatgaacatatgttttaaaaggaatcccaattgctgcaggagcagatggtgctacaggggcaggcaagggcaggagaaaggatactggctggcagtagggtaggagtcctgggctctgcctcgccccttcctcttaccagccgtgtgagctgtgtggctgcgggcaagtcactccccggctctgtgctgccccattttccttgtgaagaatgagtgggtcccctgtagcatgcaggatgagctgaggcctcactcccctgcggtggagaggacagaacactctctccatcagcagggaagacagattttcctatttattagcctgttcagctggcagacacagggactgtcctctaggccatggggtggggaagagggggacagagccccacaccagcccccgctgtgtccatcctctgcctgtggctgtttgcctgattgatttgtttggtggcctccctggctgggattgggtccctgtgtcctcctgcacatttgcctctggtccctctctgtgtggtcaggagggggagctctaggtgtaggggcggaagagactggaacatctatccatcacggactgactcttgggcttggtaaggatcctaacaaccaccgggtccacctgccaccttgtgctccgggcccctccccagaagctccccctgcagtgggaggctcactgcctctcgctgagccactcccagaaagttcacccttttctggatcccaagtcgagaggctgagacgggtggatcacctgaagtcagttcgagaccagcttggccaacatagtgaaaccccgtctctcctaaaaatactgtagtcccagctacgggaagctgaggcaggagaattgcttaagcccaggaggtggaggttgcaaggagccgagattgcgccactgcacaccagcctggctgacagagattccatctcaacaacaacaacgacaacaaaaagcagcggggaaaataatacaacacaaagctgctgtggtctgaagggcttaaaacagtacctggtgcatagttagtgcaagcttactgagtgttgagtgttattactgtcaatgataataatagaatgcctttgaaccctt

SEQ ID NO: 6131 - DNA, 5294 bp, Homo sapiens
ggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 6132 - DNA, 381 bp, Homo sapiens
ggtccctaccggcacatcacacactcctggaagcatgatcttcactcccttccttccacctgctgacctgtctgtctttcagaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatg

SEQ ID NO: 6133 - DNA, 453 bp, Homo sapiens
ggccctcggcctctttgcacccggcagagtgacgagcttcgccggtgtcttcaacgaagtcctgtcggtccctaccggcacatcacacactcctggaagcatgatcttcactcccttccttccacctgctgacctgaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgtt

SEQ ID NO: 6134 - DNA, 2643 bp, Homo sapiens
cctcgcgccccttcggcccgtcccgtccagcccgggctgcccggctctcgcaggcccccccgcgccgaccgcgttcctatggacagacgcacagacacctgcaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagaccaggatgaaagagcagctgagctcagcagggagcagaacgagaaaaccatccggagcacgcagaccgcgctccgcaatttccgtgagttcctcatctccaagtatccttctgaaacaagagagatttatgtcatcccttgcaaggagttggatgcctaccttgcctctttctttgttgatgccaggcagaaggatgggtccgaatacgaacccaacagcttggccaattaccagtgtgggctcgaaaggtacctgaaagaacacaggtatggctatagcatcaccagggataaggaattcaagcgttcccaagaggccctgaagcagaagcaaattgaactccgctgtaaaggaaaaggaaataagccacacaagtccatgaagctcacctttgctgacgagctcatcctgcggaaaaggggactgctaagccgatataaccccgagggtttgctcaacctagtctggctcaacaacacaaaagcttttgggcattgcacaggcttccatggatctaccttaaaatggggtgatatccggctccgggtaacagagacgggtctcgagtacttggagtggatgggtcaggacactggagacttgaatgccaaaaccaagagaggggggacagactcccgtgtgtatgccacccagcacgccccacagacctgccctgtccaggactataaggagtatgcccagcggcggcctcccgccatgcgctacgaggatgcccctttctacttatccatcaagccagtcgtgaacctggcggctctgcattggtacaactgccaggcccttggcaagaacaagctggccaagatggtgaagaccatgtgtgagaagggcaacatccctggcaggaaaaccaacttcagtgtgtatcagagctgcagcaccttgtctgaggcccagagcaaccagctcgtgctgatctgtaacaatctgagccagcaggctgcccagtcagtggccggccactccaacaatggcaatttcatcgtctccgcctcctatgactcttcctcagacaccgcttgaccaggtggcttgagcaagactccagtttggttactgtgtccggagaaactgtgattatacaccgcttctcgttccccttcctgtgccctcagtgttaattcactttataaaaatataaatatataatatatttttctttttacaaataagccaatggagataatttagtattactaacatagtatttataggcttaagacaaatgtacttgtgggcgatcaaatgtaattactgttacagactttacaaaaccatacgtggttctcaggcaacacaaagtagagagggaattctgttt

SEQ ID NO: 6135 - DNA, 2361 bp, Homo sapiens
atggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaaaacacttgaaaatctggaataa

SEQ ID NO: 6136 - DNA, 573 bp, Homo sapiens
actattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaa

SEQ ID NO: 6137 - DNA, 3551 bp, Homo sapiens
attgtactgctactatgcccgctactgagacaggaacaaagagaggctgtttctgcctcttggtgctctccattggacatgtctgctgggcagtgctggcttttaccataggtatttttctgctcttccttccctcctcctctccctctctcttttccagggcactcacacacacacacttgcacacatgtgcacagttgcacacacatgcattgaacacatgtgcacatatatgcgtttgcatccacttgcacacccacacacctgtgcactagcacccatttgcacgcatgtccacacacttgcacacatgtgcatttgcagaaatgcacccttgcacttgtgtgacacacctgcacacttgcatacacccatttgcatacaggcacagacacactcgcatacatttgcacacacagccacaaacttgcacaagcagcacttgtacactgacacatatccgtttgtgcctatacagtgcacacttacacatttgcacacagctgtgcttgctcacacatttgcacacacccacctacacacttgcacacatactacacacttgagcgtgcagcacacatacctatgtgcatacatgcacatttgcacatgcacacagcagtggcacacacttctctatcactctccctagtcactgttctcccctgtgattcccacccctctgaccgcccctgctcacttgctgccccctccactggaaggggcctggcctggtgccctgtctctgtctgtctccaccgtgcagggaggtttcacaaggactggctgatgtctcgcctcgagctggcctggccgcagctgctgctgagcggaagtctctgaggggcgaggctgagaggaaaccacactctcactggggttcccgcagctctggcctctggggaggggtgtggagatgtgtgggcgtgagatggctttgagggagggacagcatgaagcttttcgctgggtctgtcttttcagtctccaggacaaaactaggccactgtgctccaggagaagggaaaacccacgtccccccaggctgggcccaccggcaaatcgggctcccaggcccttctcagcccatgcttctgtctctgccttgtcaggcttattctttggggctttgaagcagcctttggtgggcaaacggcatctcagggaaccctggcctgtctcctccagagcttgtgccttggccctgggcaggggccaccatgggctgttgatgtaaatggcatccccagagttgtgcagtgtgggggcaaccctgaggtatcagcccagccccctgtctgcagcttttgctacccagcccagctccagctctgtctttgtcactgggggtggtgggggaggctggagctcagggacggggcactcctggcagattctccctgccccaggtggaaggggaggggggaagtacccatcctccatcctcctatcctgccagcggggtgggcgctactatgctggggagggtctggctgaataatgatgctgagctcgggacaccagccttctccgtgcacctactgtgtgccaagtaccatcccaagagcattatgggtggtaacttatacaatgactcagagaggcaccgctataatcacccccagtttctgtctggttccagtcctggccacacagctaataagcagcaaatggatttgatctgattttatctgaacccaggcaggctggcccagagcccactgtctaatcattgggccgtccagcctgtcaagactccaggctcgctggcgtcgtacccctctgtcatttcccagggaaacaagctctagcagcacctgccctgtgggtactttggccctgcctccctgcctccctgcctccctgcctccctgcctctcatgataggagccaaagaatggtctcctttgcaggaaaggagctcgacgggggtcttctcttgcaggctctgtcttgcatgtgggtcctgagctttctcattgagtaaggggagggggcagctggttcagtccagcgcagagtggatggaggccagttgaggctttcttgaaaccctaagcccagctgggatcctcggggaaggatccttcgctgggatctgactggctcttccagaggtcagtggggcatgtggctggagcccaagtaggagggaggaagaaatggtggtctgagtcctggggtgaccaggccctgaacctgccctgctgggaccccattccctgactctaggccccctttccccaccacacaggacaccaggctcttgccttaagacaggaaaggaaatgccttatggtgaacaattctccaggtccctattgtggctccaacagatgccagagggacatggcaggtgaccctggtctcctacgaccctgactttacttgctgtcatgaggccaatctcttaccttgacccacctcctgcctctgctttcagaagggcagaagagcgggcctcctctagcttcccagccgcctcccgcctcctgccgcccggcagcgctgggccccccagcagcgaggttcaggaggggaagaacctctcgcaggtgaacaaattgctgcacatcagacacattcttttcaagcctcattttctctccttttcatgctaactttcccactattaaagagcatttttaaaaagaagatgaaaaaaggcagagagaaaagaaggatgaaagtgtgagcgggtatccggaagtccttttcaattgcctgctgctgtgcagggtctgaactaagagcaagaaattggaggatgctggaggggcgaggtttcgtttcagtcctgcctattgggccaagtctggggcggggaaggagaggtgatggaggtgggcctggctgggccctgcggccctggaggctgcccctctgcctgccacccagcccctggcctgtgcctggcacaggaagcccgtcaataatttcttgttgaatgaatgaaagaaaagaaatcagtggatggagaagggctggattcttttgtggggaccttccacgccaccttctctgtggggctctagggctgagaaagaaaggacagatttggcaaaggtcaggcaggggctgggaaagcattaggtggaccaggcatgctacagcaaggccacgcctgcactgttgtcccactggtgacacccatgggtgcagccatggcgggtgggcgcagtttcacatgggattgggggtgagcctgggttgggtgggcgacccccaccccttccctacccctctccccaccagcaggtactactgggtctgcgtgaagataaaagctcaggaacatgccaggaaggtgtgaccatgatgatacctctgagatgaacccaagaagaaacagcagagtattacaaaggggaacaggactcagggtggacttcaagtatcattaaacataatcaaatatttaaaaagttattattgactgggtgcagtggctcacggctttaatcccagcacttagagaggccaaggtaggaagattgctttagcctaggagtttgagaccagcatgggcaacatagtgagaccccatctct

SEQ ID NO: 6138 - DNA, 125 bp, Homo sapiens
agaggaaaaacggccaacagcagccccgcggccggcccggcagcgcccggcccccggctcagcccccggagtgcggagccgaccagagggtaacgcttctcacaggggaccctgtctcagcagcc

SEQ ID NO: 6139 - DNA, 2369 bp, Homo sapiens
aagcagaggatggtggatggcagaacaaggactatcatcaatgacattttcttcactgagcccaccccagaaatgagctcccttcctgtgcgctctcacagctccttgtcgttgaatctcgtatcactgatggtaatttgcagaggaataattaagttggtgattcactttaggatgtactgccctccgaggctgaaagctaaacacatagagcccacgttacgcccagtaccacttaaggaactgcggattagtcactggcccaatgaatgcatcagacactcagcttcagttcccatggcaacaggggctaatggcctagagactaaagatgagacaaagagaaacgcagagaaatgtgcgtgttctgtcttcctctgaggtacgcaagcccctattcagggattgaaaagaacattcgctttagttctaccctgccctcccctcaatgctgggtggaggagggcagaaacgcagacgggcctgacatgaatccagaatttctacatcctctcaatgcacctgcacggtttggagacaggcttctttgtccccgagccatcatgttaccaacaatgtattgtacctgcaaaccatgcctgtggaacctaggattcctgctaccccaactcaccttcctctttaccaccctctagcctctatcacagtaggggagttttttcagtcattcctattttctgacagaaagttccagccagcccaatttcagaagcgctgtctcaggagggctccctgatccttcctgccagagtcacacaggacacacctcctccctcttctcctctgtggcctgggagacctctgcccagaccatgggacaagttcctagggctcccccttcctgccacactcctgttccgccagggccttggggagactcagacgagggaggtttctgatagtctcccacttctggaagcagccaaactaatgagaggcctcttgcctgcccctcttcctgagaagcccaccacctcctgtgtattgactccccttaccagaggctggacaaacagcgtgccaggcccgacatgagacgtcccacactataaatttgtgataaacaacaactcaaaagctgggcatatgcccccaactttccctcccttctttccatttattccagtgagtctcagaagtccctttgtccagctgcactctcctctcctgggacccagctgccctccatttcccatgtcctggaacccctcagtccaaaatacctaagtaaactcgtcttcactgcaatgtgcaacccacacccacagccatgccctacgccagaaggaaccacatgaagttctgcccatcttcctgacctccacggatgttgcgcgacatccagtctcctctgggtcagggggtttgtctcatatgcactcctgagtgcccacctgccagtgactcccctgtgtttcacacccctctcgggggatctcagatccactcggctcctggtctctgtctggatgaccacgaccagtttcccttggagaaggaccaatggggaatggcaatgccaggaaggcaacgcttcgcttgactgctctgctccttaaatccccaaaagcaccactcacaggactgtagacgctatgccagttacagacttcagcgaagggtcaatagtgactacatgaaattatagtggaacaaactactagtgagcgatggctaagcatccatgctgctagaatccaaaaagaatcacccatcccctgcctcccacggaaaagataaggtcttctgaggacattccatttccggtgaattcccgttcatggcttttcttcctgttttgagcactgcccttttctctccctggaaagaaggaagtccctccattaatctgcttcattgtagggatttctttatctctcagtaatgggatctgtctatgtctccacctccctgtgaacatgtgaacacccagagacaatcaccaaacactaaggagctatgagtgtcacatcataatccctcacctagctctgcgcagtggctcacacctataaccccagctatgcaagacaccgaggcaggaggattggttgaggccaggagttggacacgagcctggtcaatgtagcgagacctcatctctaaaattataaaaatagaaaaaattagccttatatggtggcacgcatctgtggtcccagctactcgggagactcatgcaggaggatcacttgagcccaggagtttgaggctgcagtgagttatgacagcaccactgcacagagctttgggaggctgcactttgaaggcaggagttcaagaccagcttgggcatcacagcgagaccccaactgcagaaaaaaaataaaattaaatttaaaaaaatt

SEQ ID NO: 6140 - DNA, 2369 bp, Homo sapiens; identical to SEQ ID NO: 6139

SEQ ID NO: 6141 - DNA, 846 bp, Homo sapiens
catctgtatagcgggacaggatgtcacagatgtagagattcaacaggatgagagtgcctgagctgtgacgggtgcccagaacatgatctcaggaacacatatctccttttccagccggaagtacctgagagagaccccagaaggtggataagactgcagagagcagggagcatgaagcaccttgcccaaggtctcaccaggcaagagaagggcggagaagggcggcttcttcatggattgtaaatccccaaagcgtgcaaacatctgcccccatctccctggaggtggcctgttctccacgccaccctcacaggctgcctggcggactctcctcacagcactgtgcttcccggggcccacttgtacaggccccatgcgagaaggacctcgggcagtgtataatcctccaagggcccacaggaacagcagtgacaactgtgttatgaagcacctactatgtgctggggacaagaatggaacaagaagacatgctttgccctcacccctggagggcagcttccagccagggaggcaaatacctcctccccagactccttccacagatccccaaactctgcctctctccttcagatccctgctcagatgtcaccagctctgtgcagcctccctgccaccaagtctaaaattgccatagtcccctcagttcctcacccctctccctgctttctttgtctgtctcatccatgaggatgtgccctctgggaagggcaggcaggagctggctattctgttccttgccctgtccccagcaccgaggacagtgccaggcatggaggaaataattgctgaataaagaaataaaatcgacattctatgagacataaa

SEQ ID NO: 6142 - DNA, 520 bp, Homo sapiens
aagagaagggcggagaagggcggcttcttcatggattgtaaatccccaaagcgtgcaaacatctgcccccatctccctggaggtggcctgttctccacgccaccctcacaggctgcctggcggactctcctcacagcactgtgcttcccggggcccacttgtacaggccccatgcgagaaggacctcgggcagtgtataatcctccaagggcccacaggaacagcagtgacaactgtgttatgaagcacctactatgtgctggggacaagaatggaacaagaagacatgctttgccctcacccctggagggcagcttccagccagggaggcaaatacctcctccccagactccttccacagatccccaaactctgcctctctccttcagatccctgctcagatgtcaccagctctgtgcagcctccctgccaccaagtctaaaattgccatagtcccctcagttcctcacccctctccctgctttctttgtctgtctcatccatgaggatgtgccctctg

SEQ ID NO: 6143 - DNA, 651 bp, Homo sapiens
gcctggacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaa

SEQ ID NO: 6144 - DNA, 717 bp, Homo sapiens
ccccagatgtcagctgtctatacaccaccgtcagtttccacacaccagatgccaagaaaccccaatccacagcagcgcccccagatgtcagctgtctatacaccacggtcagctcccactagatgcccccagatgtcagctgtctatacaccaccgtcagctcccacagaccagatgccaagaaaccccaatgcacagcagcgcccccagatgtcagctgtctatacaccaccgtcagctcccacagaccagatgccaagaaaccccaatccacagcagcgcccccagatgtcagctgtctatacgccaccgtcagctcccacagaccagatgccaagaaaccccaatccacagcagcgcccccagatgtcagctgtctatacgccaccgtcagctcccacagaccagatgccaagaaaccccaatccacagcagcgcccccagatgtcagctgtctatgcgccaccgtcagctcccacagaccagatgccaagaaaccccaatccacagcagcgcccccagatgtcagctgtctatgcgccaccgtcagctcccacagaccagatgccaagaaaccccaatccacagcagcgcctccagatgtcagctgtctatgcgccaccgtcagctcccacagaccagatgccaagaaaccccaatccacagcagcgcccccagatcagcgcccccagatgtcagctgtctatacgccaccgt

SEQ ID NO: 6145 - DNA, 910 bp, Homo sapiens
gctggaggggcctcccttgcccacctctcttcgctggcactggcctcccgcacccgggtctgcagtccctccgccatctcacaggtgtgcagccgctaggcctgggggatccgaatgactggggctggataggaatgccttcgtgtttcccaagaccccggggcctgctccacaaagtttgaagggtgggaggagttgaggcgccttgaattttccttcgtgagtttggagaccagccgatttttcatgaagctagcaaagactgcggtcctggatcctgcaacatatacctcattttctccaggcctctccacttgctcgagctctcagccaccaggagacagacggaaggggcttctgggctgtgttgggagcgggcactgtcccctacccactcctgcacagtttcccaaagtccagcgacctccgaccctccttgggggaaaaaataccagtacccagacaactctgcatcctgttatatgactgggcttgcttcaggaatatcttacaaagaagaagaagaagaaggaagaggaggaacggcttggagtcatgtttacatctagttctactgatccgttcacatctggagagtttatttataactccctctataactctctgtttggaggcactggtggctctactgacagactgatgtctaggaaatattgctctatgtctaaccgtacctaaatgtgctgtggttgtatttacagatttacgtttgagggaaatataattatttccattgtatttgtgcatatacagtagttataggagcagatttatatatgggaaaatatacgactctcttacagccatccggctttatgtacatttgatatcctaacagatttatatctctgaacagctatatagataaaaacgtatatcgttagaatta

SEQ ID NO: 6146 - DNA, 366 bp, Homo sapiens
gacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgcagctcaagccagtaggattacttgaggaacacaatgtgggagagaaagagcgtggtcaaggacaacaccaatgtgttcagctagactggcagaaacgagccgccacgggtgtaagt

SEQ ID NO: 6147 - DNA, 2199 bp, Homo sapiens
aaatggagtccagggtaatctgtcagccgactgtacgacggggagccctgaagcactttaggaagcagagagcctgatgcacgctgggaaacggagtccactcactcagtctattagctgtgtatgcctcccagagctcggtgcgctctgggaaattgagtcggcccgcgtgaacctgcgggtctcgggccgtgaggcaagccgggaaatggagtcgtcgccacgccctcaccgcattgcaggtgtaaagcgatttttaaagcacgccgggaaatggagtctcaggtggtttttaagccccaggtggatactgcagttccggagatgggcgaggaaatggagtaggtttacgcgctcctctttccaggtacgctgggccgcagtccctgccgggaagtgtagtcagcaccaaggcctcagtgcagttgccacagcgagccctggtgtgttctgggaaatggagttcgacgtatcctccccattgactgagggggcgggatcgcccatgagctccaagcatgctggggaatagtccagacctgaccctctgtgaggccagtctgcggaggcttgccgggaagcgaagtccaatggccaccatcaggggcgtgtgaacgaaaggttagagactgcggcagttccctggagagacttaaaagtgtttcagcgcctccttcctcgcccccaggtccttctttaagaaagagccgaggtcgatcaaggactgctggaaaatggatccaagcacctttaagttccaggtgaccatagatcaggaaagaaaaaatgtcccctctctaaccgcaactctgcaaagattcgggaaacaaagttcccggcggtttctcagaacactaactagtcttcggatacagtctagcttttcctagcaatgtggttcgcaccaggaagctgaatggagcattaaaaagacggaaatgtcatttctgggcctggcgctgtggctcaggctgggcgccagtagctcacgcctgtaatcctagcactttgggaggccgaggctggcggatcatccgaggtcaggagttcgagaccagcctggccaacatagcgaaacccccgtctctactaaaagtacaaaaattagccgggtgtggtggcgggcgcctgtaataccagctactcaggaggctgaagcaggagaatcgcttgaacccgggaggcataggttgcagtgagccgagatcgcgccactgcactccagtctgggcgaaaagagtgagactccgtctcaaaaaaaaaaaaatcctgtcttgaaccaccattcagttttcagtttttggtttgttttgagacagggtctcgctctgccgcccaggctggcgggcagtggcgcaatcacaggtcactgcagcctctaactcccaggctcaagcaatccccccacctaagcctcccatgtaggtgggactacaggcgtgcaccatcacgcccagctaatttggtttggtttgttttttggggtggtggggggtagcggggtgggcttcgccatgttgcccaggctggtctccaattcctgggctcaagcgattctacctcagcctccaacgtgctggtatttcaggcttgagccacggcaccgggcctcccactcttgtgttttgcatcctccgcttcctaaattacaagatcccggaaagccaaaaataaggaagccagctgcctcaggttttgtgtactcagtgagtcgtcctatttatcgattaatacccgaaggagagtagcccccaaaaggcgctgggaaacagagttcctgtgtctgtatgtgtctcttcctcccccggaaatacttagaagtagaatgaaagcgttctcagcccctcccgcatcctggaatggtgggaaatggagtctctggacttcacgttaatccgagcttgtgcttatactaactgtcctgtcctttctgaaaccagaagaaagtcctgtccactcagtttgttcctgactgcaattccccgcggacacaactgcgggggtcggtagcgccaaagcctgttgagactacattacccagaaggcaaagtgcggaacacttccgctcccttcacaaagcaggtggccgcaccacgcgcggctaggcgcgggcgtttctgggagttgcagtttcccagccaaatggtacctgctgccctctgatggcagctctgagtcaaaaagtaaaaatttcagtcg

SEQ ID NO: 6148 - DNA, 2240 bp, Homo sapiens
gccagcaggcgatggaatagggactacgagacaccctgcagcctctcctgggaggacaacgccccttctccctctccatgcactcttgaggcagcaaagaggaggcatctggacgcgtttacctcctccccacccccacagcttggccctcactaaactatcttgtgtccttcctcctgctatgattgattcgcccaggaaggagggagcgctctcccctcctctgggaggctggagactcggggacagaagatgcgctggagggaagagaacggagcgtcggacaccagaaaaactttgggggattcggggtgagaaagaaggcgtgaagagagaagggaggctcagcaggggaggaggggcgggggcgggggcgggagcgggaggagtcactgcgccgcggccgcccctccccgccctccactcggcggccccgggtcttcctccccctcctcctccccctcctcctccccctcctcttcctccgcctcctggtgtggctggctgcggccagaatcggagccccaaccgcgctgccggtgagtgaccagccccaggggacagagacgggaggcctgggaccccccctctccagggtggggcctcccgccgtgtctgggaaagtttgcgggcgccccgggacgcgggcatctccagggccgctcggcgcctccccatctccccgcgcccgccctggccgcccccaggggcgccctggggcccgcagagggatggcctcccggcagggactcctcggctcccctctgttctgagactgctgctgggaccggggtccgactctaaagagaaaactcaaacagcaaaaaaaggaatatcgactcagttccgagggcgggggccggggctcgttctcacccgcgcgcggcccctcgacctctcggacccgggccaccagctctgcgcccctcacgcctccctcggggtctctgtgtctctctcccgctcccggactccctcctccttctgactgctgttatttgggctgttgtccctccccgctccctggtacctcagctcggaccttagcctgtgcctgcagcccggagtcccctcctgccctggaaggcaaggagccaggccacggggccacagccgcgggggccaccacactggcccaaatatttcctgcaggtatgaccattcactgggtattggggttgggtcccttggacccacaaactgaacctcgtgggtacagggaaaaattaaaatatattcctccttaggattgtactgcttctgttggtttggcatctttttatttttaacccttctaactgtgctttcttcgaataataatgatacttcatgtaattagcgtttctaatatctaaagacagaagaaggaagaaaataaacggaagagagagaatgcttgctaaaaatactcatttttgacttcagtccacactcgactgttttcctgggagatagaagttcagtgtagcttgttttcagactaaccgcaaacacgattacagcctcctccaggctagaagttttaatttgcctgacatgcagcacactgtttgttggtattcccagcctggcattcccgtctgcatagctctagtctccctcccaactcccccacccccactttctttctcataaaagggagctgtgaaaacaaggcaatgggagaggctcaaacgagctggaccacataataaaaacagccctacttattttaatcctgaggctatggactcccctggactctgattgggtggaagaattgtttagttcatttgtgtggtttttctgtcagtagttattatggttgaatcagtgtttccatgacagtcttgcttctgtgggcacgatggggagcctgttaattctcggatgggtctggacagatcaagtctggagtctggagagatttttcagggcttgacctgggctgatattgcaaacctctgcacactcactcagaaccagagcagccgggagcagcctgagctggggttttcttccacatgatctgggaagaaaaagctctaccaaggagcgaactgtgtgagcatggttgctgggggatgttgaatgttttacgtttttaggaagaacacacttctcaaaactttagccattcctgtttccatacaaacaataaatgtggttgtaacaaatgtagtagatcagattctgaacaaccccttaaaaaacaggtccaagtattgaaccatttggaaataaagattttattttatttg

SEQ ID NO: 6149 - DNA, 1326 bp, Homo sapiens
atgcagtggaggagaggacagacgtccggaactgggtagagatgggcctgccgtgggtgcgatctgctggggacacagacccacgcagcaggggagaggacagacgtccggaactggtgctgtcccacgtccccacccctgtggccagctccgcccactcagcctcagccttgctggggcctggcccgacctcaggagtccctgctggcctggccacccttgtgccttcgcctcagccatcggggaggctcgggtggtctcagggccaacgccaggtgagacctcagggggggtcaggggcttctgaacaaaaacggcacccccatacctgatggggctcctctgagcccacctggactgaccccctgtggccgccaggggcagctggtggcctgcctgaatgtgggggcagtgtcacccctgagcccagagagccggagcacagcagggtccaggatggccccagctacagacactgcctggcttcctccacaccccgagatccagctgcgtctcctctgtcccggggaaacttacgggaaacttatgggcggaagtccctctgcagggcccactacccagagccagccacatgcactcaggccagggctcaggggccgtgggggctggtggccccagcccttctggatccactccccacccctcactcactccgtggggaccttcatctgcctagatgggctggtctgtgctctgacggccccaggactgggtgtcggcctcaccccagcgccctggcggcctcccggccagagtagaatgttggaagggcatggcccatggccgacgccaggctcccggccagggcccacctgtgtttgtctcctcaccccggcctcctccagcctcaggccctgcctgtcagacaggggcacttgcccaggggctcctcagggagcagttggtacctgcagagcaagcccccagagcccctgccacaggcaccccagcctcaggtcaggtctggaatggacacagcccccagaccaagaccagggcctcctcaccccggggtcccctcccttggtgtcgggtgtcacccaaactccctggacgtcacccttctgccctccacgccccacaccctgggtaggagccgccttcacagctgctaacccctgccctccagcccccactgcctcttcggtaacggggctgtgactggcctaagccctgggcctccacagggcccctgtccagcccaccttgctcaaccgcagcgttccgcatcacgcctgccccttagtggttggggtgtgcatgtatatttatacactgtaattacataaatacaatttaataatc

SEQ ID NO: 6150 - DNA, 3468 bp, Homo sapiens
agcgcgttggggctgcgtctctgcgcactggctggctctgggctgggaagtttcaagttccaggcggtctgcattcccttctcccccttcacacacttaaccctaccttgtctggtcaagagagatccagacaaaatcaaccttctgcgtcaacagccgcgtccggctgcctcagaggcacagagtctgttcctggcttcacctggctttcgccataaactggaacgagcggccaagaccctggatgctgctgcggctttgcaaggtgaggactcggcgcccagcaccttcctgtgcaagaagtcagggagttcaagacgagatcaaggctgatccaggccttgcgcggctcctgctcacaggatcctggggaccgtttcaagaagagcctcaggacacggagaatgctcagtctctctcctggctgtccccgccaggcaagagggcccgggggtggagggaatccaggggacacggtcctcaccccactgtcagcgccggcagaccccaacactcatcccccagccccaggcacacaacccgccctgccgcccctcgccaggccctgccgggtgtccaccctctgaggtggcaggtgggggaggagacatgctggggaggggcccaggcctgggcggcgcggcccttcctttcactcccctgccaggcagtgcctgcgcccaccctcacccccaccaccccccccgaccccccgcgggctgggaggaaatgtaatgagtgcagggcggtgtctttggtgctgctggggtggagtcaagggccagatcccattgtgaatttgacagaaaaggaaacgggctccgagcgcaggtgaggctcagccagggctccgcggctctcacccaagagctgagctccaaccttcctggcccggctccgtttcccgagctgtggaaaatgcctgtccacccggcatggctgggtagtgcctgcctcccccacgccagccacgggccggctccccagtcctctgtgggagggttgctggtctctgttaaaagccccccgggtgacgtgcatgccgccagggcctgtgcccccgggagacactctggggaggggccaccacaaggaaacctcagtccaagctgtccagcggaggctgggcatggctgtgccagcacaggaaggcaggtaggggtctccggggcaggcagctctccctctggcccagccccctgtgtgaagtgctcagcctgggtaggaacgtgcttcccactcagcctcctccaagccgctggaggtcccgctggttccccaaatggcttctgtcctgagccgtgggctcctgaccacgcacctaccttgcacggtctgaacaagagtctgtgccagggaccccgctcaggaggggcacagaggaagccaagggcccacacaggtgagggggtctcaggtctgggcctcacccagcccaggctcagcagcagcctcagaatttcctggcatctgcttgcctgtgttgcaacccaagtggggtgtgcatgccgcctgagagagaagacactcggggaggattatgtaagcgctttcctccccagcacagggccgtcttgggcacattgcgaccagaccatgtgcaaaagcactcgggagagtggcaggagctgacccaccagagagggattaaccccttccgggatgctggcggcttgtcctggggaacgtggggctggtcaggattgcaggacacggaggggcggagtgtgaatgtggaggcaccggtgctgcgtgattttccacaagttgtctaacctctctgtgccttcgttgcctgactcggctgtttccaatgcagctgattttaacagcacctgtttcatgaggccacagccaggattctgggaggcaaagcacagaaagccctcaatgcggtttgaggctccaggcaaggctcagctgacagtagctgaaaacagcaatttcagccgcagagttgcccgtcctgtgcaccacagaacgaacaagggtttccagctttgctcagatttgtggggaccactgggtttggactttaggaaaagctcatttgcctttgggcagaagtgaccggagctggggtcacctgaggtctgggcaggaacctctcgctggctgacgcaggacctggggaggggccatctgtgtggggcagctctggactcagacccgtggatacctgtgaaacctgtcaggctgagccaccgtccagcaagtgaagagaccccaactgggccactgtggagtcacttggccaccacccccgggttctcacagccctcatgtgtgtcccaaccgcgagcaggcggccgacagtgcaccctgacaaggcacgcgtgtaccatcggggacacctgctactttaaagtgaccggatggtgcccaggaccacaagaaccagcctcgtggcagggtgcccagcctccttccccctccactgttaacttttttgccaagattccaaaaacgaagctgcagctgaaaataatttctttttcttctatagcccaaatgaccgatggtgtagagattttcccatcatagaactgcagtctccatttctagtaggcccaggaggtgacatgtctgaggttggggtgccttggggccagtgcccagaggagaacccacattggcgtcctagtaatgtgaaccctcataagagcttcaggacagcagaggcagtggagatgccggcaggcagggagagccggcccggccagcccctcgggaatgagcttcagtcctattctagctcaaaatgataaacctcatctcaggcggctgcttgtgactccaagagaccaccaggccccggtgatagccagcacagtacctggcacataaatcccacccaccagcctggtgtggctgggagacccgcccgggtgctctctgtctctccctccctctttcactgctccctgaaggcagcatctgaagaggctgaggctgtcctgtcgctgccccgacctctgcggagaagcccgcggctgtcctgtcgctgccccgacctctggggagaggcccgcagttctgatcacggacctcagacggggaagcgcacaggaggcctcgggtggccgggctgtgctgcttctccctggacgggcagagctggcacataggaggtgcttcgcaggtgactaaggaggcaaagacccgaagcctgggggactgcagtgtccggtggatcccagctgtggccatcaggcccatgggtgggagagccaagggaggggctcagctgggcaataggatgcgagtgggcgggggacactgctgggaactcccttcactgcatggccaagaatgtgtgtaagcaaacagggcgggagagctgtgtgtcgcctcgggcagtcactcagcctctccgcccgttttcctggtctgtaaaatgggccgaaacgcccgccctgctctgctctttgggcagtttctataaatgcttggcccagcctccccggc

SEQ ID NO: 6151 - DNA, 3914 bp, Homo sapiens
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttc

SEQ ID NO: 6152 - DNA, 2361 bp, Homo sapiens
ggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 6153 - DNA, 2731 bp, Homo sapiens
accggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 6154 - DNA, 3821 bp, Homo sapiens
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttc

SEQ ID NO: 6155 - DNA, 2122 bp, Homo sapiens
agctgcgtttgctttggttagctagaaagcaggcccatcatgcatctgtaagaaagtgactggagtgtaggccctggcgtctaagccgagtaagatgccctgtcaatctgggtcctctgggaagcaagactgatgaaatgaggagcaccaaagctttacaccccagctatgtgcatttggggctggggctgcctgggaagagctcgtcctcagcccaaagcctgcaacagctgggatcagggcttacctctcacagacggggctcagcaactttctgcgggatgaggacacaagcccacttgacctggaacgtctgaaacctcctggccccgtggaagatgggaagaaacactcctcttcctctcagttttacaaccgagtggtcctcgggctgcttgtgagcaccggacgaccgaccgagcaggctgcagccaatcagctggcacagggctccgactgaaaatcatcttggctggtgccacagaatcggcctgaaaacaggatactgcctagagcaaggcacccaggggagccaagcaggaaaatgtaatgaattgactttaagtagctgcagctgtgattagagtatttttagccacaggactcaaccagctttcaaaacctgctaataagagccccaccgtagccagcgcaaaaatttagttttcagtttaacaccaggaatctgcttagctaggagctggcttagaaggcacatcaggagagaacatcttctactgaaagttgaagatttttcattttctagctgaattatgacaaagggagatgaccattaagtgcctgccagcatactgggacgtacacctaacactctgaaaactcaattcatgccagcacatctgtcttctgctgcatctagctcagcatcatgtatgtattttgggcaaaactaatcatttcacaccctagactttaaagagacccagaatctaatgatagctaacatacccaccccctctaacaggctttggcgtatttcctgtgagaagcagttactggaggccgaatggattccactcatccacagcactgtgcatgcaacagccagattaggccccggtgggactgcgtggcccactgcttcctatgggctccagggctgcccagcagggatgacccgggagccgacaagggggaggccagtgggggcgttgggacggtttccttgaccctgtctcaacccagagaaagaagcctgcaggtgaaaaaggtcttcgtgaaaggaatgaaaaaggagagggctttaggggaaggggctgcctggtggcaaagccagcgccttgtgtccccaggcaaacatgacagagtctcgacgcacaggaagagccagtccgtctttactggagtgagtgcgggagacaaacagtttacaacaacctttagcattgtcttcaccatttgataaaaagttcactattatatttattgtataatgaagaaaaacaacacattcagggaaaaattgagattaacttatttttcttaaaaggttcatctcaaggatggcaacaaagtccagcttgtgccgccaaacggttttacatgatcaaaccgtgtacagcttcttgtgtgaactgttgactacaaacatttaccaaatacataaatctcttttaaaaaagccattttaaatatagcaaagcagtgtcttcttgcacagcaaagtgaagaaagtttctacagagaaatagaagttttacatttgtaaaatctttttcacattctaatcatctagcttaagatccaatgccaggagttttcagcttccttatttactatgtatttcttgtgcgcatgatggttaatacagaaattatgttgatgcattactagttatccttctagttaaaggaaagggtaaaacatgtattgttcttgtagaacaaacccctgatttagtctataacaaaatggacataattgggctcaaaagatggagttttgattgggaccacctgtgtacacacaacagtgacttccactcgcggtggagtggccattagagtactgaggaaggacagctgttggaaactgtactttaaccagtgcaatttaagctttttttgcttttgttctttagtaataaaatacttctggaggg

SEQ ID NO: 6156 - DNA, 1393 bp, Homo sapiens
ccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggcaaa

SEQ ID NO: 6157 - DNA, 2469 bp, Homo sapiens
actattaaagcctctccggtatctgacacaagtcagaatttccactgttccagctgagcttttatgaggagcagacttgagagaaactgccaagattttctggagtacacagggcacacggccagctgaacacccgcttcccccactcgctgctgctgggaagagagcaatggactccgaataccttccagccgaaagtcgtcctcctcttcctcgctgagcgtgtctctcaacacgtcgcccacgagctcctacaagaagacagagcagaggcattgagcaggggttgggggagcccagtgctgggacgttaaaagcagtgccatgaggaccctgggctgattcttctgattggaattcaggtcaactgaggcagatcctattgcacctgaaaagttaagtgccaaggtgggtccctcctgcccttaacataaacccacacgcatcagcacaacattcaggccaccacaggctatggctccactgggtcttccatcatgcctcccacatttcaccaacacacatgccttccggaaaccagcctgattccttgcacacaccctgcctgttccccaccagtgagttaaggatatctgggatctcatcccaaccaacctgaccaggagatgtcaagttagcgaggggagtgttgctggtccacaggctgggaaatttctaggatgtcaacaaaggccccatctgtctgacccaccctagcaggataactccaaatatggaagaagctagaccataccttgtcaaactgtcttctgtatttattggtattctgccagaagagttctatgatcaaagaagattcttttaaacaaagttaaacaagatctcttacagcaggacttatcaggacttttcctatggttctaaacactgaatctccaagtgctggcatattttgcattctccaaacttatttagaccatggagcttcgtttttcaaaagtatcacatgatacgcgtgtcccaagaaacccactttaggaaatactcctgttatgggaggacagacaagggtttgggggatgatgatgctatggtagcggttctcaaaacacaaaatgacaagcaataaaaaagcccaaactcagcagctgtcaccaacttctctttgtgaaaataaaagagaaaaaaaacaaaaacaaaaacaaaacccaaccctctccttaggggaaaaaaaattctacacctcagatgatgcttaaaaaaaaaccagtcctcttcttgatgaacaaaagaaaaaacacggctttgtattgctgatctcatcaactggacacagctggaggtaagcctcttgcttttttttgttttttgttttaaagacaaacagctaacattttgtggctgttctctttcttctttcaaatctttctagggcattacacactctttcttaaaagctgttaaaatgtggccattcagactccggtgtcccatttacttcaaaaccaggctactttattcctcgagtcaggatggcttcctctcctcctccaccaattattataatcatcgaacatatcctgggcttgtaaactggctgtttgtgttaacagagcccgagttgacaggggagctgggagacgatgacaggaaagggatgcacacaggtggcatcattagatggctgggacgccccagcagccaattgaagcccatctttcatgcagaagagagacgggtgccaccgccccctgaaaggctggtaggcagagcttccccgagggaacaggcaacagtcttcaagagaatctgcgcacctcttcatgctgaggtcttctgcagagcggggctctgcgcctgccaccctgactgcactgcagccgggtgacagcatcaatgagacgtctgagtactcgtgtctttttactggcacacttggaagagtttaaagactccagacatcgccaccaacaaggcagccgtgtgggaccctatgacaatgaccgcatgtgctcaaggcaccccagtcaccacctaatgacagcttcagcactccctgctcggagaaccaagctctctgacacactcagaaagcagagttctggcaagttctggcataggcctctcaccactcaacagtaccctgctctggagaacactggaaagctccccggagccatggttcatggacgcactgtactgtgccaatgctcaactttgcaaaaattcatctccccagccaggcgcagtggctcacgcctgtaatcctagcacttcgggaggccgaggcaggtggatcacgaggtcaggcaacctggccaacataatgaaaccccatctctgctaaaaatacaaaaaattagccaggcgtagtggcaggtgactgtaatcccaactacttggggggctgaggcagaagaatcgcttgaaactgggaggtggaggctgtggtgagctgagattgcgccactgcactccagcccaggtgacagtgtgagactctgtctc

SEQ ID NO: 6158 - DNA, 1802 bp, Homo sapiens
agtcgccgctccagcgggaggcaggatggttgctacctggggcggccgccagctcctcccgcagtgctccgggccgcccctcaccccagggtcgcccgctcctagtgtggcccaggcttcccggcctgcccctcccagccctaggaagacgtcccccgggccccctcagccctccgcctccccttctctccctttctccccgctcctggcaggctgcagccgtctcctcccggtgctcgctccttccttgagctctgtccaccgctgcccactgggggctagagcttcccggctaccctggaagctggaggctgggaccagctcttcaggtgacaggcctctgtgtctccacagtggccagaggggagcctgcctgactgatgagcaaggctccactttgtcaccaaggcagagaaggggcccgggtaaatgaccccggtggcccccacccctgcctggcatgagagtgggtaggggcttcggacttgaggggactggagcgggaataagggtcttctctggcccagcctttgactgaagctggtctggagacaggggcgttagagaagtgactcatagatggcctaaataagcggggccactcaaggacccaggacagggggaagagggccaacccatctggaccgcaggcaaaccccatggcctttgagagaagagagaagaggacccggtgaagtaggctccgagggcctcagcccagcaggagcgcagggtgggcgcgtgatgtcatcgaagggaagacagtgacctgggggagggccgctttgagggagagtgcaggccaccgccagagagctctgggagccgagggcagggaagactttcagatgttgcttgtccaaggggtgggggtggaagggagagagagcagaggctcgagagggatgtaggagagctgatggcactttggggacagcctcagggctgcaattgaggagggctctctccctcatgcaggcttttcctccaggagctgcaccaggaactcacagaggatcagggagaattctgagaacatgctactgtggtgctgcctagagaggaaggataaatgatgacaagtacatctctgagtaacgtatgggcacttgttcatgaaaactgtttttctgaaagcttgtgaaggtcttgaaatactcgctatcagttgaggacaaacatttacaccctccttccacagggagttcaagcaggctggatgggtccatctatggatgatcttccccagccccttcctcttcccagctcatccctggctctctgtgtgaacaggtctcatcagtggaatgtggttgatgaagtgaggtcttcaattttctcatctactgtgtggtcatgttattttcctcatctgaggcttaaaaactcacctgcatgcagcacatgacagcttaaaatctcttgtgaacaaaacagtaacaaagacacccaccagcgttgagcatcccgtgttgatgacagcgaccaccaggggtcaacgtcctcttcacaatcctgtgtcagagcatcacttgactgatttcattagcaacttcccaggagaatcagcttacaaaatacttgtcccattttccatgcagatgtaacccatctattttactgaagaaatgggaagagctgaatgctgaatacactgaatgtctgcaggttgtgcaagtttgtgactttatcactttctaatttctgatctgtgtggaccactctacagatttttctcactggtgtgatcagccttctggatgtcaaatataatagactttcaataatataaaagtcaacac

SEQ ID NO: 6159 - DNA, 573 bp, Homo sapiens
ttggggttcctctggttggctggctaccatgcatgtcgtgtgttgcttatatcagaaggtgagggttctgtgtggtgtagatgctgtcggttagccggccttgcttctcacaaggggcgtttctggggagaacgctggggtctgtgtgggctcaaggaggatcccgtctccccttatgtttctggtacaggatcagatgtggccgcccagcagttgtgcacataggaggagaaggggccaggtgggaaaagggagcaagaggcaggaaagagcacagacttcgacgttcagacctgggttcccgtccagttccattccttgcacagggaatccctgacatcgtcatccgtctcctgtgcctttccgctgggtcagcctcctcccaccaagcttctgacccactgtcatccgcagctgccactctagctgcagagctcgactgggctctggtttctcagaagagctcagaggacctggctcctccctctttgcttctgaactgcatttctttccttattactcagtgtccacacccacggtggctgcctggataaaaatctgcccctttctccc

SEQ ID NO: 6160 - DNA, 3058 bp, Homo sapiens
acgtgagaccaccaagttcactgcttcaagcagcttagagtccagagggcatggacacatgccggagccaggacaagaagagccaccagaaagaaggctaggcattaaggaacagcaagtgcaaagttcctgagggaacaagcagacagagtctcactacgttgcccaggctgttctccaacactgggctagtgatcttcctgccttggcctcccaaagtgctgggattacaggtgtgagctgcaaggctaggtcctcgggctcctcaggccctgggccccctcccaggaatgagtcccgccgctccagcacaaaggggaagaagccctcgtcgccgctgggagaggcgccccctgagagcggcccggacgggaagctgggcccatctggagagctcatgtcacctgcagcatctgcggggacaggtggctgcgggacactctactctgcagcctgacaggggctcaccctccgcccagcacctggccctccaggaattctccacctgctgccagcctgcccggtcctgcagccagggcttcctgggccacaaagggttaatgacctgtgttttggctacccagttccgttaatgtccctggggtaaactgaggcaggaagcagaaggaaatgacctgcccagcctttggcctctgccagacaatctctgtccccaggaaagctcattccagtgctccagggccacaggccacctctgctccctgtcccctctcttcccagaacccagcagtttggcttgtagcccctcgccatctgagacagttcccagaacccaggttctcagggactcagcagttggagttgggcccagcctcttctctcaggaatgcaggaccctaaggcttgggaactgaggtatcttcgcccccaggaatccagctccttcccctgccagaagcccagatcccagcccctgacctcccgggtctctcgccctcattctcctgctacctcctgagcaggtgctttgactccaccctccagactcagaggtccccacctccaatgtcccccaccaaggattcccaccccagtccccattttccacgggactcaggcattcatgcccccacccctccggactcaggagccctgaccctcagccccccagtttcccagggccctggcgtggggcccaggacagggcgaggtaacaggttgtgccggccgcccggccgcagcgcggctcggagtttctgtttacttcccggtccgcccctggggacgggagccctgggctcccctagggcggctcaggggctggggttcaggggctcgggtcagagggcccgacacaacagctttaccagccccagccctccgggggctcaccacccactaggcacacacacccgtgctctccctcctcctctcgcccggtgtccatgtgcagccctgctcgcaggacgtgagtgtcacggtggtcccagcccagccgcccccaggccgctcccggggacctccctgacttggccctcgcgggccccgctcccccgcccccctccacgcgagagacagggacctggagaccgctccccctccccttccgcacctagctgcccaggtgttggggcctccagccccaggcgtcggaagcccagagaagcggctgggctcacccccgacggctgagttcctgccggcgcccccggttccccggcgatcccggttcccctgcccccgccccggctcccccaccttctccgccgacgcggccggaccaggccctccccaggctcgaggggcccggccctcggcgtcccccaggctctcacccgaagccgccgggctccctccgaggtccccgcggtctccggtcccctcttccggaggcggctccagagatgggattttgctctgtcacgcaggctggagtgcagtggcaccatcactgcagtctcgtcctcccaggctcaagcgatcctcccaccacagcctcccccgtagctgggactgcaggctggagtacagtggtgccatctcagctcacagcagcctccgctcccgggttcaagtgattctcctgtctcagcctgcctcccaaagtgctgggattacagagtgagccacctccccggctcaacttgttgactttcatgatgacctgatgacgaggaactgctgtcatccccatcttacagatgaggaagctgaggctcggaggcggaggggggtcctccaccttgtttggggtcccctggtcagaactggaagactccagggctccctgggcctcgtgacaggggctcctggcctggagagcaggacagatggaaggctgggagcagtggcgtgctggtaagcgtttaacaacaggctccccggctaaaacaatagccctcgctcgttgcatttgccaatatccatgatgcaatacctgctcctcggctgacttccagctactcacctggcgtcacggagtgcagaggtagaaggggctgtgcacatcagctctggctggctggtgtcagctgggtccgtgcacctctggctggggatcaggactcctgagtcttgggggactgggggctacttacttgggttctagaaaaataggaggagggtgggggctgggactcctggcttgtgggaaaaggggagcaaggactccttggaggggtgacttaggaactgggactcctgggtcctggggctgggacagggttttctgccagcagagagtaggggagccagagatttgtcttacagccacattgcccagcaagcctgacactttctcccactgcacctgtgggagcagcctggtagccactggaggactgaagacatcccagcctcccctgggtgctgctatgtgaccctctggaaatagaagctcagtgtcccctccaaatgccagtcaccctgggccccactcacacccacacgtagcacatcttgagcgcctcctgccaggctgagctcatcccaggatgaagtgattacagccctactcccagaaggttcacagtccacctgggccatgggagggagcgtagacctataaaccagaaatgaaccaataaaacagtacagc

SEQ ID NO: 6161 - DNA, 2387 bp, Homo sapiens
gacttcaggaccctactgagagatggaatcaagagctctccggggttctttgagtggggagttgtatcggaaaccaccatcagcgcgcctgagctcgcctcgcattgttcttctgtagtgcggggggccactgccaccaccgtgaggacacgttggggtctggggagggattgttatggctgtgggtgcaccttgcacgtcttgccgacctagctttgcacgctgatcttccctccgtgcccgcttacattgttaactgggtttctgccctccctcctctccttcgtatttctgtgtctcattgacaactgttctgtagtcgctttgttgacagttgccaaactgctttccaaaaacatttccactgcaatcccggtttttggtgccagccgcagtggtgtgagtacgctcgctttattatagtcttgccagcactgggcgtctctgtgtattgtaaacacatgcgatcatcactcttatctctccatcccccccacaattaaagatgtgccgtgctatctctgctcaggttaccttggccttgggatgagttggctggaggctcaggcagcgcgagggacaggaggagggcgaggcgctgcctggtggattagcggggagccatggcacgggcaggactcaggagaggaggccggcagctcacagcagaccgcggggctcagctggcctgccctgtgcttggggtttgtttttgagcgttgaaatgaggtccttaaaccttagtccgtgcattgagagcaaggcagctgccttgagccttacttccttttcctctttgtcgcctagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaattcttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaatgtaagctggccgggatggcgggcgaggcaggtggcactgggtcctccgtgcactgggcttcatgcccgtgcgccagacccacgtgtgatttgtagccgaaaggggagggtgtctgtgccactgcggcaggcctgctggtggttgtagtctttgctgccgtgaggcagtggcgggtgaggtgctgggtgggtcattttctcctcatttccgtggccgtggacaggctagtgagtttccacccacagggtgccgctagaaccggacgccgagcacccccggcactggccccggggtcccacgtacggggcctcctgcccggcctgtcgcatctgcgcttggcttggtgcttgtacaactgtgcggccaagatgctccagaacactgcctgtctttccacagaaacccccgagtgttgtgtgcttgaacttttgggacgtggcgttggtggggacactggtaccttcttcagtgctgagtag

SEQ ID NO: 6162 - DNA, 4853 bp, Homo sapiens
cccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaggcaattaagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcaggggagaggagaggcctgatggggcagagctggacgaagtctgctaagagagatggaggctgtggcggactccttccaactcacgatttatcctcagctcagagtgtattttgaatatgagcaaatgtttatgtacgtatgagatttcaagttaataaatcatctctatggct

SEQ ID NO: 6163 - DNA, 820 bp, Homo sapiens
gagagatttcatctacgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggaggtgatgctgaggtcctgagacctggcccggcaaaaccagagttgagcctcagcaaaacgtgtagccacttgaaatcgatagagctttcctttgtgtttagttttatagttctctctgtatgtcattgttcctcttagttgagtttttgcctgtcaaagagatagagagctgcttttatgctgagatcctcaagccaaaacccacagtaaacgcaaagtaaaactttgaggctttgaactttta

SEQ ID NO: 6164 - DNA, 7340 bp, Homo sapiens
cgcgcgcagctggtcggcccgcggcggtgctgcgcggatccggcgtcggggcccggcatggcgggggccggggccaagccgggccggacccggacctaaatgcctctgttcttctccgcgctgttggtcttgctgctagttgcgcttagcgccctctttctaggccggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgaggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctc

SEQ ID NO: 6165 - DNA, 4560 bp, Homo sapiens
gccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgaatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttgtttttccttttagagatgggcttttgctcttacccaggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttc

SEQ ID NO: 6166 - DNA, 2993 bp, Homo sapiens
agctgacacagtgagttgtccctgacactcatgactttcaagccctgtgtcttggagggcactgtgatctggaagttcaccttccccatgaaaaaacccaaaccagcctctccttttcctgcatggtgatccgtctgtaatgatcagtgacattctcagaattaaccaatcaggaaattcttggaaagtccacgcctcagcatttagtgcttgggaaattctacttccagatcccagaggggacagagcagatttccagttctcctagcaccaccatgatctcaggactaaccactgcacacccgtgatgggattccaaaccttcgctgcaagaggacaaggtgacgagttgctgacagtgaaggctaaactaacgcggacagtgaagtgctacatgagtcggactcagactccaggtgaagcagccagcagaggtcagagagagacagctcacgttccggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 6167 - DNA, 2446 bp, Homo sapiens
aaaatatgaacagatacagcttcatgctttcaggaaaccaccttctcttccatcttctcctttggcctgctcagacagccagacttcttaaacatatttttcctacaggctcatgcaaattaagggatgtggctgagcatctccttcagtgccctcaaacaggtcatgaatgttgcaaagcccagaatcgtgctaacctggtagaaggctggtttagccagaacacacagagaggaccttctcatgatggtgtggctgaattccacatgtcactaacagtatcttgccctgacccgactccaagtactgatccccaaggaaggcataatagagagcccatcttggggagggatgatgacttcatgtgcaaacaagtcaaattcaggatgtgtgttgtgggcagagatggcaatgcccagtcatctgttaggtatacaggtccgctgtacaggagaaaaatcagaacagaatttctatttgtagtgtttcttttagagactagggaattgaaaccacaggtgaataagaatgtacaaggaaccaggccttcttgaagaaatagctgaaccagattggtgtcaggagctgtacaaggggatccaagaatgtcttgtcatacaagccggacagctattaaagacaactgaggtcatggcaaaagggcccaggcttctactggccaacaatgagacaatttgagcatcccaaagaataatgactttagtggactgaaacacatcaacatgtatacatccatgaattcataatactcaaaacggtaaaaccaaactcatttgttacctttggaggagtctgtcacctctgattattctgaaaactggtaaatagaaggggaaaattcaagcatttattctgcttttcttgtataaactgtacctcacagttacggaagagctgataagggaaatgtcttctttattgaaaaattcagctgatacatttggaaggaatgagagaattacagtaccaccattaggtgacaatgagggtctggttttttatttttcttttgctgagtgctgggaacatagtgataacaaaaaaagccatagtgttctggcccttctggagttttgattctagcacattaaccaaataatcccagagcaaaaataaaatgtcaactatggtaagtgtagagaagggaaaatacacagaacttttaacagcttagatccgaggaagctgaccagcctgcaaaaagggacagcttccctagggaagtgactttgcagctgtgatgatggatgactaagagttaaccaaggaatgggaggagggaggaggagacagagaaggctttccaagcagaagccagagcatgtgcaaagatcctgtggcaagaaggagcctggtgcaggggaggaacgaagagacatgcaagctggctggagtgcagagagggagacaggcaggcaggcaggtggttggatggggaggcaaggatcagatcctgagtcccttggagaagcaggaaggcatcatgatgactaatgtcagaggcaggggaggacaggtagggatagacagggaagcagtgctgggaagatgctaaaatgctgcagtttgtgcttggaaagatcatggcctggttcttccattgtcatgatgggttgttctctttcttattgtttttctaatttgtcttgactaatggagaagatcaggagctcaaaaatagaggttgtttacagcactcagtttggctgctataggttaatgggcttagactctttaaggggattaggcttttgctcagagaccagtggagtattctagccaggctgtcttgtgaaggtggtatgttaagaactaggtttgtctgatttctcaaattaaaatgtggtacatcaaattaaatttgaatttcagataaataacaactaatttcagatgtgtcagataaagaatggatatggctctagtacaatatgggataatgaatattttcagataaatagatgccctgtattctgtgtagcaagcataactagagaatcaatgttagtgctcaaactaagaagacttttgagaaattatcagaggtaaatacaaatatacatttccatccatccatccatccatccatccatccatccatccatccatccatccatccctgttgagctccaactatgtgtcaggcacttctggggggttgagggtattgtgatcagtaagacaaactctctgcctttatagtgtttacattctaggagaaaaatattcatcttagagagattataaaaaacaaatcttccgaaatagtatctgttacgtccaaaatagaggaatgtataaataaatgttaatatgatggactaacacgcagccattacaaaaatcctgttttgaaggctattaaatgtcatggtgaattgattccaatataaaaccaaatgaaataaaagcagttcacaaaacc

SEQ ID NO: 6168 - DNA, 1404 bp, Homo sapiens
acatgtaactataattatctttattatgcagcaaaattttttaaattgctaacttttaacttcatgtagaattattcagtctaacaatatgaactgatcttttcttctaaagtatagaataattacaggatagatcagagagaaataatacagaaactgaatatagttaaactaattgaatgaaagcacaaaatgctttgtatgtaaaattcaacaatatatgggtaatgtgcagaatatttttgcgttaaaaaaagttaatctcccagatgtgagctttgttagtcaccaacaaattatgtactgactgaactgctgtctctcaaacacagttcaagcatgccttagccactaccttaggtacttgaccactttaaggggttttgtggcatttcaaaaatcaaaatctctttatccagatccttgtaaatattcaccattacaggtaagaaaaacgcattttagggaagcagtgaattctccacttggaatcaatctactgattgataattaaattatttcactgtgaaccagaaggctagtatttagaaagcaaaatatttagaagtgaaagaggggggaaaaaagaatgatctacaatgtaatataaattaacctaatttaaattagattttaatttaacctactttgatagttttttaaaacaaggaagatcctaaggacttgcaactatggcaatcctcaaaatgggaccaaaaattgtcctggaatggtcaggtggtcatccatctaaagatccatccagctactatttaataattcttcataaggacacttcatctactctggttgactgtcattttcaacatcataatttacataaggtaggcttcctttattaaattcgtattctgtatttcagatatttctcaattttagaaaaacaatgcacagtgtgttaagagcatattttcaacttcattcaatgcattacctaaatactgcatattagctcatgcggtattgtgtaatactgcaaagaccgtacttacgtaaatgttggttaaagttaccaattatacaaagctccactctctacctaaaattttaccatgtgcaaaacgaaaaacattttagttattgatcatctcttctgagccatacactttgggcaaaattttgtgatggctataaatatgaaaacacttaaaaaatcagaatacaaagaatgcatattgcctcacatgacacatttttttttttccctcagagaaagaccatctgtttaggataaatttctagtcttgtttatatagtcaagtattttttgctaaaaaagaaaatgagaagacctgtgctgtgaaaaattttaaaaatctcaaatttttaaataaaaaatcatttataaaattcaggatggatggctctaaaatataaaaagag

SEQ ID NO: 6169 - DNA, 622 bp, Homo sapiens
ggaagcggcggcgggagcttccgggagggcggctcgcaggcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccaagagctcactcccttccaccccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataa

SEQ ID NO: 6170 - DNA, 2149 bp, Homo sapiens
aaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggat

SEQ ID NO: 6171 - DNA, 991 bp, Homo sapiens
gaaagtaaaaatttttattttgattgatttctcaatgtatagttcagtataatgccagtttttaatggcaaaaatttggttccactgaaactccataatgctacagagagctactactttttccaggaagtaggttaacagctagaaagaaaaaggacaatttcctagcagcatggcaacttaaactgcagatctaataggtctgcaacttttacactaaaaatggcacaaacagctggtgacacaagtgagaaatggggaacaagatgtgaacactgaaaagaacaatatatatactgtaaatatgatgaataaaccaaatgtagctataagaatcttaaaggatgattatagaaaagggaaccaaatattttcctcaaatgctttttagagcctttctgtagagatacaaatatatatatatatatttatccaaaaatatgttttatacagataaatgtttctcaattaaagatgggaccaaagctataggtataacataaagcacattgtcttttgtaagactatttatccacctgaattttcaatttctttaaagttagtgcattaaatgttttccaaatataattacctgtcagtctttttatagatataaatcaagtaggcattatgttttaaaagtgtttgcaggttaaacttttctaagatgctgtgcatattaaacttattatgagccccattaagaatcattattaataaacatatcaaaaagggctatatgtcagattttcctgttcatagtaaatattttctgatttccagtttacaagtattgaaaatgcacaagaaagattttacttcacaagtacttttaagaatatactttgatttaatatgtatgttagtaaaactccacgtgttgtaacgattattatgtttttgtttttaaaatggggatgtaatactaataaccactacctataaaataaagcacacaattgttccggtgattttacaaatctttttttcc

SEQ ID NO: 6172 - DNA, 2700 bp, Homo sapiens
tggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 6173 - DNA, 6511 bp, Homo sapiens
ccctgccctccccgagctcggtcccggccactccctccgcagctgggcgtcgccggccgcgctggggcgagaaccgaagtttggaggtagacgagcaggcgagcggtttgcccgggcgcagagcatgaaggccgggcgggcgcggggagcgcgccgccgccgccgccgccgcccctgttgcgatggcgcagaaaccccgttgacaaggcactgctttttcatgacgcaaaacgtcatattatttcacaaaaagcccagcgatttcacctgaagaagcttgggaactcctgccaaaaattgtagcacttctcacattgcaatgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgt

SEQ ID NO: 6174 - DNA, 6515 bp, Homo sapiens
ggcatcttttcaggatttcattcctacgtccaactgccgttcacaactgccctttccaactgctccagaactcttggccctggcattccgtgatgtaaattattccacacatggctcaaaagggtgtgaagctgtgtgccaggtgtcggatcactagtttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatg

SEQ ID NO: 6175 - DNA, 1184 bp, Homo sapiens
agtcacacaggtgcctgatacgtgactggaggtgttcgctgatgtggccccaaccctgccttcctccccaccccacgatgttagaagaaactcaacagagtaaattggcagcagccaagaaaaagctaaaagaatatcagcagaggaacagccctggtgttccagcaggagtgaagatgaaaaagaaaaacactggcagtagccctgagacagccacttttggtggttgccactcacctggggctagtcggtaccaagaactggaattagccctggactcaagctccgcaataatcaatcaactcaatgaaaacatagaatcattgaaacaacagaagaaacaagtggaacatcagctggaagaagaaaagaaaaccaacagtgaaatacacaaagcacagatggagcagttagaggcaatcgacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacaggtcctcgagctgcagagaagcggtcctccagtggcggttacagcagaccataaaggagcaggcactgctgaacgcacacgtgacacaggtgacagagtcacttaaacaagtccagctagagagagatgaatatgctcaacatataaaagaagagagggcccggtggcaggagaggatgtggaaaatgtcggtggggctgagcccccatccccggcacccccagcagtgacctctgtggtggagcagctacaagatgaggccaaacacctgaggaaggaggtggagagtttggagggaaagctccaatccaaggtggaaaacaaccaggccttgagtctcctgagcaaggaacaaaagtagaggctccaggagcaggacgagaggctccgagagcaggaggagtggagggtgcgggagcaggagagactgtgtgagcaaaatgagaggcttcgggagcagcagaagacgctacgggagcagggtgagaggctgcgaaagcaggagcagaggctatgcaagcaggaggagaggctgcgaaaggaggaggagaggctgcgaaagcaggaaaagaggctgtggg

SEQ ID NO: 6176 - DNA, 57 bp, Homo sapiens
tggatctttatttttaaatgttctgtcatgtatgttcatttcttttttgcctttttt

SEQ ID NO: 6177 - DNA, 1677 bp, Homo sapiens
cctagtcagtgggggtgtagggagtggtattttgttcagtaggggcctggtcactgggggtctggcacagacccaggcccaggggatgcccaatgctgggaggaggctcagacagcaggaaggagagaaggaaggaaggaacttccgtagtaccgatgcctacaaaattacaacacgtggtgctgtttctactccatcaccatgttcgctctttatttcctatgtaattctctattcaaccggcctcagttgagcacaaaaccatccttgtaccaccatgaatagttggccatggctctttgatagcaatttttgttctgccgtagaaattatccttgaaccagaaaaaaaaatccccaattcaacactccatttttgtgaagagctggttccgaattctgggtcactttttggaaaaaatatctgttgtggtaaacagtgctgcatctgtgatctcaagtctctactggaattggatagagatggtgaatttcagccagagcgcccaaagaactcgtgtcccgcgctcctgaacgccatcagccgccgcacctccatcttccctcctcccacgagtctcctgctccccgtgactctggcctcctcgcagtgttgctgggccacgtcaggaagtgctggaggacgtggcattgcaccaacaccaggcggccagccgtgtggctcatcccgcaaatcaggctcttcctgtgcatggagatggagtccctctggaggcagcccgtggccctgttctcgggcaggtggagcatggagacgactgggaacttcactagacacgcatccagccggttcaagggcttgtcgcgccgtgcaccagcttgcaggagaaagcccaacgcctcgccaagcacgaaggcctcccttcccgacttgatgaaggcagagtagcggttgaggttgcggctcacagtgaccgagctcctgcccacgtggggacccagggagccgtcgagctccagcccaggcttggacctgaagaagctggcaacccgcgaacgccaacaggcacagtcgaaaaaagcaaaagaaaaatcccaaacaaaatcctgttctccctagccaaaggaccaggagagggggcagcccagcaagacaaaacacatttacacaattctggctaacctcagccagtccttggccgtgagttcgtttttctgccacctcactttggggctgggctggttctccaccctcgcagggtgcgtttctcaatccagacgctggggggcgctagtacctcgcgagctccgcgaggatcattcccgggacgccgcggagtcacctcccctcctagggacccagagcttcccagggccgcgcctgtaggttttccagaggtccccgaaaacgttaaagacctggaaggaaaaaaaaactgtaaaaccacacactttgatatttgacaacgtaaaagcaaggctgcaaaatcaaaatcaatgaacgcttgaaggaaatgtctacttagctagacatagtgccacctggattcactgttggctccagaatcccccccacggtgtcatcacgttggaaagtttttgtgggttagatgttctctgttggcaagaatgcctgtacatgcccaagaagcatatgagtttaatgggaccccaataacttcaaaagcaaaaagataacgatcctttctactttttt

SEQ ID NO: 6178 - DNA, 865 bp, Homo sapiens
gaaggaggaaaggagtgagcatgtcctgctcctgcatgtccctgcttaagctcaggactggcccttccaggccaaggaccccagcatagaccccaggacagggccccaaggatccctggctcatgagagcggcttgctgggctgccccaagagagcctgaaggaaacacattgttgagctgagctgacgtcgctgtttcttccagactgctctctaaagtgggcagggtagcgaccggccggctccgatggtgacgtcccactgccaaggggtgggagtggggagagtctccacagagcttcggagaagctgctaagatggaaaagtggaaacttggcagacagatccagcctccctggccactggcccatgctcgtggctcctggatggcgctgccacgttctgagcagcttgggacaggtggagatcaggactggcagctgcaaggacacaccagagccacagaaactaaagagaatttccaaaaggagtctatggtgaagtctctgaggatgcaaagaagacaaggagaatgaaaatccaatgaaagcctgattgtatttgttgaccttaaggaaagtgattttatggtacagcctctctggaagggagggtgtgttcgctcacagaatgcaaataccctttgaccccctaatctttcttctaggagtttctcctacagataaacttagaagggtgctcaaataagtaagttcaaggatatcctctgaagcattgccgtagtataaaaaaagcacagataccctcaaaggacatcattaggggcctggtaaaataaattccacacagtggaacaccgtgtagctctttagagaataaacagctctctatatgtgatctggaa

SEQ ID NO: 6179 - DNA, 1921 bp, Homo sapiens
tttcttctggtcaatccatctagtgttaatggttctgaaacatggattttattgtgtcgtatttctgcctgagtagtcaagcattcttctttgcctacagaataaattctgcattttttttgactcattttcagactctttcaccatctagtcagaggctgtaaactagtggcctgtgggccagtataatcctacatccccttttccccccatcattttcctttatcttctagtagaaatcttctcgttccagttaagttgttcctctttattttcccgataggaaatactgtattctcctcttgaagcatgtgctctggctctttccctctattatttgtcttctgtgtaaattatcttcacttgtcctagaaacctcctcatacacactgatatttaataaagatagccctcttttgtgaatttgcttgaaaatggaagcattagaagtaggtaaagttatgagccaaggaaataagttattcattgaacaaatattgagctgtaatataatattatatcatattatgtaacaaaatattgagtacctattatgtggtggactgtgttatctgattggggctgttacaatgatcaagaaagactatgttcctccctcattgagcttatatcccattgcaatcaatatgcaaaaataagtaggttgacagcctgccttcagagtgcttttataaacatcttacttgatctgaacagcaatcctgaagtacttgagaaaacagaagttcagctggtctcgaactcctggcctctagtgatctgcttgcctcaggctcccatagtgctgggactacaggtgtgagccaccacgcccggcctggcttcattgatttttccaattgtagtaataatcatgctcattgcttataattcaaccagtactagaaagttcaaacaaccctcatagtaatatagatttgtaaattccaaaattcgtattttattatgtctttctttgccaccttctcttttctccacttggtatatcaagaacatcatttttaaaggctaaatagacactgtatggctattccatagctgaatcaaccaaacctctgttgagaggctcttaaaatgtttcttcttgtataaaaaacaacattgttaaactttattctccatttatctttttataattatttcactcttaattccttagaaatagaattccttagtcaaattatcaggtttattcagtagtcatggtttgtgcaaaacctggtcttctgggagggataagtaagaaaaatggaccatttttctaatgaagcttaagagtttatttggggaaataacattcacttttggaatttcaaaagaaaagttaaaaattcttgacgatttaactttgttacctttgttagtaaaacaatataaaatgctgtggagctataagttaccaggatcaggtatagttatttggtccacatttcatgcagtaatggattcagaatggagaagacaaaatgcagaactgaacttaattacaaataagcattttttaaaaaatctacaatctaagcatttagatgtaaaaatattaaaaaccaagaataagcttgtggaaggaatttaattatgaagtaaactacttgtctttttttgagatggagtttcgctcttgttgcccaggctggagtgcaatggtgtgatcttggctcaccgcaacctctgccccccaggttcaagctattctgcctcagcctcccgagtagttgggattacaggcatgcaccaccacgcccggctaattttgtatttttttagtagagacgaggtttctccatgttggtcaggctgttctcaaactcccaacctcaggtgatctgcccgcctcggcctcacaaagtgctggaattataggcgtgagcaactgcacccagcaactacttgttaaatt

SEQ ID NO: 6180 - DNA, 66 bp, Homo sapiens
gatggcaaaataatgctgcatgtgtgttgtattagtctctgttcagtgctagtgtggaagttccca

SEQ ID NO: 6181 - DNA, 237 bp, Homo sapiens
gtcttgctttttattttttatttacttatatttatgtttagtttttttgagacaaggtctcactctgtcactcaggctggagtgcagtggcatgatcatagctcactgcagccccaacttcctgggctcaagcaatcccccacctcagcctctcagagtagctgggaccacgggtgtgccccacgacacccaatccaccttccccagactcccaaagtgctgggattacaagtatga

SEQ ID NO: 6182 - DNA, 297 bp, Homo sapiens
ctggagtgcagtggcactgtgttggctcactgcaacctctgtctcctggcctcccaagcagctgggattacaggcacgagccaccacgcccagctaatttttgtatttttagtagagacctggtttcaccatgttggccaggctggtctcgaactcctgacttcaggtgatccacctgcctcagtctccgaaaatgctgggattacaggtgtgagccaccgcgcctggccgggaccccagttcttcaacctagagcagggtttctccatgttggtcaggctggtctcgaactcctga

SEQ ID NO: 6183 - DNA, 450 bp, Homo sapiens
agaaacagaattcagtataaccagagtcaaaaggatatcctccaatcatggtttcaacatgaccctttccctgataaagctgccagagaacaactggccaaagaaattggggttccagaatctaatattcaggtttggtttaaaaattacagagtaaaacagagaaaactggattataagtgcttctcagaaaaagatcaaacccaggggcatgaccagtcccagcatctgactcaagaatacttacctaaagaagcccgacaaaaacagacattcatcacatggactcaaaaaaacaggctagtgcaagcctttgagaggaacccattccctgatattgctaccagaaaaaaactggctgaacaaacaggcctgcaggaatcaagaattcaaatgtggtttcagaaacaaagatctctgtacctcaagaagagcagaatggagcccatg

SEQ ID NO: 6184 - DNA, 5471 bp, Homo sapiens
accaggaagacgcctgcagagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggaaccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgccaggggtccctggagcagccggcgttgggggcgctggaggtcgggaaccgagtacagcgtcgggcgggggacagctcaatcgagctgggagcattagtacccttgattctttagactttgcaagatattcagatgatggtaacagggaaacagatgaaaaagtggcagtcctggagtttgaactacggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgactcttcgaggcatgagtgaagcgttagttgacaagcgggttgctccggcccttgttaccttgtccagtgatcctgaattctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacactttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttga

SEQ ID NO: 6185 - DNA, 2145 bp, Homo sapiens
acaccaccctgcagcaggcctggccaccggcctcagcgcttctgggagaaggtcagccaggtggaagatggagagggcttctggactgagccctggaggggggctaggggccaccagcaggcagatgagccctgggacccagctggccaacccacctgaccacggtgacaaggactgcttgggaaggataagcccaggttcgggaaagcaaattcaggctgcaggacagctgcccgggccccccacaagcctggcaccagcccagggaagactgaggagcctcactccatggggactgcaaacacctgaacacagcgaacctgaaggtatagggcatcttcaggctgctactgaggcggtcctgccgcactcaacccagaacctcatcactaaaaggaacctcatggttcaggctagagtgcagtggcgcgatctcggctcactgaaacctccgcctcccaggttcaagcaattctcctgcttcagcctcccaagtagctaggagtacagacatggtctcactctgttatccaggctagagtgcagtggtgtgatctcagctcacttcaacctctggctcaagtgatcctcccacctcagcctccccaagtagctgggactacaggcacacgccaccaggcccagataattttttgtattttcagtaaaaacagggtctcgccatgttgcccagactggtcttaaactcctgagctcaagcgatgtgcctgccttggcctccccaagtgctgggattagaggcataagccaccatgtctggcccccagtggcttctaatccgccctatctatccatcaagcctgggtggggtgggcttgctcagtgtccttcagattccttcatcaattaactcttttgtgtacgagggtgtcccaaaagcagcagccgcgagtagaatttgccttgggtcattgctgtagtctcccgcatccaggaaagatctaggccgctcgctttccacaaaccttctggctgaaacaagccacttacctggctgcagtgaagacactgatgccgctactgaagctggagtcacaggaaccatctggacctcctgggagaggaagaggaacaaggggtcatgaaaggctgttggctctcttgaataaacaagacccctgtgacaagcacacacagaactctccagagccccataccttgattcaggctcttcaaaaggaccatggctctggagccctgaggacccaaccaacgcccagtcattctcgatagtccccaagcttgtaagtctgtagtcacagtgatctcacaaggaggggacaccagtgctaaacacatctgtcaaatctcagaagggatcactggcctgaggggaatggatgtttaaaatgacagataatacccagcatccttagctatcaggaaaatgcaaatccaaaccacaagatactactgtacacccatcaggatggctaaaataaaagacaaataatagcaagtgttgatgagaatgtggagaaactggaaccctcgtacattgctggtgggaatgtaaaatggtgcaagctgctttggagaacagtctggccattcctccaaaggctaaacatagtcaccacatgactcagcagctccactcctaggtatatgccaaagagaaatgaaaacttatggccacatgaaaccttgtatatcaatcatgttcacatcagcattatctacaatagccaaaaagcagaagcaaccgaaatatctatcaacagatgaatggataaatgaggtgtggtatagccatacaatggactattatttggcaataaaaagggatgaagtactgatgcacgccataaaaatgaactttaaaaacattgtgttaagtgaaagaagccagtcataaaagactacatattgtatccctttctcgaaagtgtttagaacaggcaaacctatggagacggaaaatggactggaggttgcctaggactggaggagacgggggaatagggtataatggctaatggattctttcaagggcacggaaaatattctaaaattgattgtggtgatggttacataaccctgtgaatctacaaagtcactgaattgtacacttgatgttgggtgaattgtgtggtacatgaattctatctcaataaagggctt

SEQ ID NO: 6186 - DNA, 470 bp, Homo sapiens
gccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgc

SEQ ID NO: 6187 - DNA, 616 bp, Homo sapiens
gaaacaggggcacacgaaggttaagcaacctgctcaaggtcacccagctctcctgctctgaaccacatcctttgctaagaacttcatgggcagtatcccatccaaaccttgcaacaacccagaagggcctcttcttcagggaatggaagcagccgactggaccgggattggagtgtgtctcccacctgggggcgccagagggcacatatactgctgtactcgtttgtgccaccagagggcagcctccgcacatcgatctctactgcttccgagaactgtccaaaccggcgggactgagagagagaaacctggtccagggcagagaaagagaggagcccactgcagtgcgtgcaagcgatcttccacgcgtccatcctgaatgtgttaaaagcagcagttaaagagggagggctctggagttggactgtttgcgtttgaacccagactctgggcaaaagctgctgaacctctctgaatctaatagcctcatctgtgaattggaaggatactagcgaggattaaatgagagtgcataggaagggcctagccccggtgcccagcacagaggctccatatgtgtcaccgttgtcaatttctgactcatgtattcatctat

SEQ ID NO: 6188 - DNA, 501 bp, Homo sapiens
atggaccttataaaagtactgtatgtgaaaaagcctttgattttcccaatgtaccttatatacaaacacgaaaatctcatactggagagaaaccctttagatgtaagaagtgtggtcatggtttcagttattcctcttacctttgatatcatgagagaactcacactggagaaaaaccctatgaatgtaaaaaatgtggtaaagccttcggatatagtagttccctatgaaaacatgacagaactcatactggagagaaaccctatgagtgtaaggattataggaaaatgtttagttatgccaatcatcttcgtagccatcaaagaactcacaccagagagaaaccctatcagtaaagactgtgggaaagccttcagatcttccagtttttgtcaacaacataaaagcactcacactggagaaaaaccctatgaatgtaagaaatgtggtaaaaccttcagattttatagttctcttccaaaacataaaagaactcatact

SEQ ID NO: 6189 - DNA, 1802 bp, Homo sapiens
agtcgccgctccagcgggaggcaggatggttgctacctggggcggccgccagctcctcccgcagtgctccgggccgcccctcaccccagggtcgcccgctcctagtgtggcccaggcttcccggcctgcccctcccagccctaggaagacgtcccccgggccccctcagccctccgcctccccttctctccctttctccccgctcctggcaggctgcagccgtctcctcccggtgctcgctccttccttgagctctgtccaccgctgcccactgggggctagagcttcccggctaccctggaagctggaggctgggaccagctcttcaggtgacaggcctctgtgtctccacagtggccagaggggagcctgcctgactgatgagcaaggctccactttgtcaccaaggcagagaaggggcccgggtaaatgaccccggtggcccccacccctgcctggcatgagagtgggtaggggcttcggacttgaggggactggagcgggaataagggtcttctctggcccagcctttgactgaagctggtctggagacaggggcgttagagaagtgactcatagatggcctaaataagcggggccactcaaggacccaggacagggggaagagggccaacccatctggaccgcaggcaaaccccatggcctttgagagaagagagaagaggacccggtgaagtaggctccgagggcctcagcccagcaggagcgcagggtgggcgcgtgatgtcatcgaagggaagacagtgacctgggggagggccgctttgagggagagtgcaggccaccgccagagagctctgggagccgagggcagggaagactttcagatgttgcttgtccaaggggtgggggtggaagggagagagagcagaggctcgagagggatgtaggagagctgatggcactttggggacagcctcagggctgcaattgaggagggctccctccctcatgcaggcttttcctccaggagctgcaccaggaactcacagaggatcagggagaattctgagaacatgctactgtggtgctgcctagagaggaaggataaatgatgacaagtacatctctgagtaacgtatggccacttgttcatgaaaactgtttttctgaaagcttgtgaaggtcttgaaatactcgctatcagttgaggacaaacatttacaccctccttccacagggagttcaagcaggctggatgggtccatctatggatgatcttccccagccccttcctcttcccagctcattcctggctctctgtgtgaacaggtctcatcagtggaatgtggttgatgaagtgaggtcttcaattttctcatctactgtgtggtcatgttattttcctcatctgaggcttaaaaactcacctgcatgcagcacatgacagcttaaaatctcttgtgaacaaaacagtaacaaagacacccaccagcgttgagcatcccgtgttgatgacagcgaccaccatgggtcaacgtcctcttcacaatcctgtgtcagagcatcacttgactgatttcattagcaacttcccaggagaatcagcttacaaaatacttgtcccattttccatgcagatgtaacccatctattttactgaagaaatgggaagagctgaatgctgaatacactgaatgtctgcaggttgtgcaagtttgtgactttatcactttctaatttctgatctgtgtggaccactctacagatttttctcactggtgtgatcagccttctggatgtcaaatataatagactttcaacaatataaaagtcaacac

SEQ ID NO: 6190 - DNA, 6019 bp, Homo sapiens
ctggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 6191 - DNA, 84 bp, Homo sapiens
gatgctgtgattctctttagtgtctggcgattaaagaagaaatccagggtactatttttcatttacattatagccatttcagtg

SEQ ID NO: 6192 - DNA, 1433 bp, Homo sapiens
gggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 6193 - DNA, 1804 bp, Homo sapiens
gctccacggtggggatgccctccatgatgcggtagtcggccaggaacggagccaccatgtcgtctgtgacggggaacttgtctgggatccgcgtgcagcggcggatcaggccggggttgacgccgttgaggtactggtacccaaagaaggtgtcctctgcccagtgctcggccacgtactctgcgaggacggcgcgagggcgtcacaaggaggcccggcccccctcggggacggagaggcatgggacagaagaagactatgggcaccgagaggagtcggggaggaaaacgaggcccccagcctggcgctgagcggccggaggagcccggtgcgacattttccaagaagccgccagagggcgcgcgcgcgcctcgctgcctctcccgtcccactgccccgaagtcgggggcctgcctagcacgccggagaccgcctggctccccctgctcgatccgggacgccccattccataccggagacgacagatttcttgccagggaaaattttcctaatgtccttcagcctcttccacgaatgtttgcagtccaacaggccgcggactttgaaagccagtgccctaggagatgggattccaggaagaggccttcagaggggctgccaagcgccggctggggcaggtggcggggccgccccatccacttaggtctctgggtctcagggtctgtgcgtcgcaaagtctctgggtcccatgtctcaagatctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacacggactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgtgcacatagctgggcaggccaggaagaaagactcgccagctgcaagggaaaccgagatgtcaccctcatgcccgtgcaccaccccagggcaaagggccagagccatcactgccccccacctccctggacccctgccgggcgcccagactctgccacccgccccctcactggtagaagtcctgcttggctctgatctcctcttttctgtgctccaggaggacggggagcgagtcatctgctgttgtctttcctgtagggagaccaaggagaggactcaagggctgacccttgcccctgcccacttcaggaagcaggagttcagcttctgtgccccaggtcgtctctgggggggcccatgaccaaggagtgggaaggctcaccttgggagagtgaaggtgcgtcctgtccggaaatatcagataaaagaatcacggacccaccctctttcctcttgctctactgtcaagctaagctctgctgctgcaaaaagtccctcctctagacccactgaaatattttttatttctataaattcatggagtacaagagcaatgttgttacatgcatagtggccaagttagggctttaggttacccatcacccaaataaagtatattgtacccattaa

SEQ ID NO: 6194 - DNA, 1140 bp, Homo sapiens
gttcatcaagaaattcacacaatagagaaaacttttgaatgtagtcatggcaagaaatctttttgccaggagtcccacttcactgagcatcacaggacatgcacaagagagaaaccatgtgaaagtagtgactgtaagaaacgtttttgtcatagctcagtcctaagagtccatcagagaactcacacaggggagaaaccatatgaatgtaaggaatgtaggaaatccttccatgtgaaaccaaacctcactaaacatcagaaaacacatataggggagaaacctttcaaatgtactgcgtgtggaagaactttcttccagcagtcaaccctaaatgtccatcagagaactcacactggggagaaaccctgtggatgcaatgaatgtgagaagtccttctacaacaaggatgccctcattatacaccagagaactcacactggagagaaaccttacaaatgtaatgagtgtgaaaaatcctatctgaagaagtcacatcttaatattcatctgagaaatcacacaggaaagagaccccatgtatgtaatgaatgtgggaaggccttttctatgaaatcaaccctaacagtacatcagagaactcatggggagaagccttataaatgtaatgaatgtagaaaatctttctatatgaagtcagccctcagtcagcatcagaggatacatatatgggaggaacattgtgaatgtaaagaatgtgggaaaacctaccagaggtcacaccttgctaaacatcatcgaaaatacaccaagaaaccctatgaatgtaagcaatgtggaaaaaccttccagaagtcacacctcattgaacatcagaggacacacccaggggagataccccatgaatgtaataaatgtgggaaatccttctgttataagtcacccttgaccattcaccagagaactcacatagaagagaagccctataaatgtagcaaatctgttacttatttctgtatgaaatcacacctcactgtgcatcagagaccccataccaggaagaacccttttgagtgtaatgaatgcaggaaaatgttttatgtgaagtcaaacctcatcaatcatcagagaactcacacaggggagaaaccatatgaaggcaatacatgtgggaaatct

SEQ ID NO: 6195 - DNA, 3080 bp, Homo sapiens
gattgtaagtttcctgaggcctccctagaagctgagcagatgccagcaccacgctttctgtacagcctaaggaactatgagccaatgaaacctcttttcttcataaattacccagtctcagatatggagttaccagtaaggagctccaccgtgactctcctccctgctccgttgccccgacgaggaagtgtgaaaacgtttctggctccatccaagagttacttccctgaagaagagagggctttgttgaagtcttcccatgctttctgcacagggctctggccttggagaagggatttccagttaccgcagtgtcacttggccctgggtctcctcccgggagagagaagtgtacggctcccaaggttcctggcagttttgaaagagctctcagccacagccagctttactttggcaagtgaggccatcccctttctttcctcctttcctttcccatggaacctactccttccatctgtctttcaagctctgcctcagaaatggcaattcaaggctgattttctccttgaatgcactctctctgtgaaagaggcttttcaccaagaatgtggtgctggtgtttctcttgccaatgggctaaacaaaggcctccgcaccgggtaacatttgggcaggcctcttcacacatgcctgtccttctccgtcgcacttggctaaagccaacaacctatgtgtgaaaagtataaagagatggaaaaattcccatgaaaaatccttccgcaaagcaattgcgagacaactatggcgtcatctgataacatgatttctattttgcatctgttccattgttggagggcactcatagttgcaagccttgcatgtacatatgtaaaaattataagtgaatgcatctgctcaggttattagccactgattgtgaaataatctgaagtttgagagtctcagttaataacctataggtgctgagagcattcaaagacccaatagcataagtattaatcacctcttttctccagagtagcaaataagaaaccaggaagagctcagtttcacttccaacttgttctttaagggcctcagagttgatagttgtcctcatctgggctccctaatgccacgacaaatcaactagaaaagaaatatgccccaaatcagcacccaaacacgctggtgccagcctgtgtccatgttcctgcaacagctgctgcccacggggtaggactgagccaggtctaagattagcagtgtcccagctcctcaggttcctgcacattgactcacaacggaatcaaaactcgggagctcaactctctggtttcttctgctttctcttctgcaattttctttcttttttttttttttaactttattttactggcaaccatgaaagagatatttacagcaagactcagagcaaggtcagagacccctaaacaggtggttttcccttaacttatcaggctggagcagagtttaaaccaaactagaggaatccctctagctctgggcacaatgtaatctctacatcctggccttcatcgcattggctggaagctggttggcttcatccaagggcctacttcgaggggattcatgcctctgcaagtttgagcatccctcactcctggcgctggcggtgccactcagccacggactggagcatccacttggtctggagcttgtacaaatagtagccataaaccacgactttggtgaggtctgaagactccagaggcttcagctcgagcatggccttgctcaccagctcaatgtaagggattcctccctcgccaacctccagagagttaaagacatctctaccacccggtggagaagaaagctgaccactggtgtgcttccagaatgcgagaagctcttgaagcccaacattccctttcagtgatattactgacattttcccaaagctgtgttcttcagagctgcacatggcattgttaacaactatttcttaaaaacatttcttttagagacgggattttgccatgttggcaggttggtctcaaacttttgggctcaagagatccaccctcctcagcttcccaaagtgctgggattaacaggcctgagcactgcgcaacaactattgaaacccttgtcaggcgcctgttggacccctggagcctggttaatgggaacgaccacagtgggcatcaaatgggtaacttcagtacgccagcacggttgagaactattgttcaacgcgaacttcacatatgaagcccctctcatgtgtcaggcacggcgtcagatgctggacggcaagaaggtggccttctgcaaatggggatgagtcctcaccaggtgtgggatctgccagcacctcgatcttgggcttcccagcctcagtactgtaagaaagtttcgctctttcacccaggctggagtgcagtggcacgatcttggctcacttcaacctctgccttccagtttcaagtgattctactgcctcagcctcccaagtagctgggattacaggcacccaccactatgctcggctaatttttttgtattttcaatagtgacagagtttcaccatattggccaggctggtgtcgaactcctgacctcatgatctgcccacctctgcctcccaaagtgctgggattacaggcgtgagccatcgcgcccagcccataagttttagtgcctttttttcatagatgctgaaactgaaaaagggtgtggttaaataatttgcccaagccagtctctggcaaagatgggattcatatccagctactgatgaccaaacatggtgagcaggtatcctatgtcccgaggaagcccattccacctgagcactggatggaagggatatcgcaatcacccccatgcatgatggacaggtctaggagcattggacactcaatggaaactcatgcccctgtcagaaattggcaactgccacttccacggcacttgcaaactttgcacacggtccagatgtggcctggcttgttgctgtcatggtagcaatagtaattacttaggggatttctgcagatcttgctcatattgtgcataatagggtataaaatatggaaaatttgcctctaaaataaagtgttgctggcaaa

SEQ ID NO: 6196 - DNA, 6988 bp, Homo sapiens
atgagtgtgcccgggacgccgggagcgatggagccggctggggaggaagagcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggcacttgagagaaaagacaacgatagcagttacatctagaggctattatggattggaggatgagaagggaactgcatgtacctcaacaaggcgtcggtcaacaccgcgaagtttggcaggcttgacaagtggagtttttgaatctataatggttcaagttttgagacaggaagaacagctgagagcaaaagaagaaaaaaggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgataactgtgctgaaaaactggggttgtgtcctcagttttttaaagttcttggagaagttaatccattggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctcttagtccaggtgaaataaggtttatagaaaatcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggaaaaaaatccgtctctaaaaaagcaatcacaaagaagaggaaaactgtcataaagtcacctactgtaccagagtttcagcttatttgcactaatcttgatgaactcagggaattaatcacaaaaatcgagaatgaactcaaagatctggaaaacagtagaaaaaaatcgggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaaaagactctcctaagggagaaatcagtaagtctatagactcaacagaacctctggatatcctggagaaagatcactttgattcagatgatatgaagttgtcagaaatagattttcctatggctagaagcaagctgttgaaaaaggaattgccttcaaaagacttaccgaagacactgcttaaaacacttaaacgacagtccaaacaaactgattatgtggatgacagcacaaaagagctttctccaaggaagaaggcaaagttaagcacaaatgagacaacagttgagaatctagaaagtgatgtgcagattgactgtttcagtgaatcaaagcatacagagccatcatttccagagtcatttgcctcattggattcagtaccagtgtctactctccagaaagggaccaaacccattcaggctttgcttgcaaagaatattgggaataaagtgaccttaacaaatcaactgcctccttccacaggtagaaatgctcttgctgtggaaaaaccagttttatctcctccggaagcaagcccgataaagccagcattgacctgccacaccaatacaaaaggtcctttacaaatggtatacaaaatgccctgtggccagtggttgccaatagatcttcaaaatagctctgtaaagattcaggtgcagcctatggtggatcctaaaacaggagaaaaaatcatgcagcaagttcttattctgcctaagaattttgtgattcagcataaagaaggaaaagcagttgcaaaagaagtgccaccacttcaacagaaaggtacagaacaacattgttcatctttcccacagacaacaaatataaattcttctttagcatcagtttttgtcaactcaccaggaactgtttctacccaactaccaaatacagctttcaacaaaacaattacacctttatcaaatataagtagtgctagaccacagcctttgtcgcctgtaacctctgtaagtaacttattaacaccatcagttaagactagccagagtgaggcaggaaaagccaagaatgcagtttcagcagccacattctccttgcccagtgcttcaccgaccatttcctccacaggtcagcctctgtcatcaacaacaacactaaatgggtctacaaatcctggtagttccttcaactgttttgcacaacagactgctgattcttctgaagcaaagcaagagctgaaaactgtgtgcataagagattcacagtcaattcttgttaggacacgaggtgggaacactggagttgtaaaagtacagaccaacccagatcaaaattcacccaatactgtatcttcaagttcagttttcacttttgctcctcagctgcaggcatttctggtgccaaaatcaacaacttcttcctctgctttttcacctgtagctggaacaactactacatctagtctttcaccttttagccaaacaccaacttctgtttccattccagctagctttgccccatccatggggaaaaatctcaaacttacattaggccacaccactggcagtggtgatttgggccacgtgatagataaaacttcacacatgccctcttctcccttgaagtcctctatttgttctagtactctactaccatcaacaacaagtagttcggtaagtgtaattagcatatcagcagcaaattttggacaaaacaatgcaaatattattcatactccaactaaacagcaacaagtagattatatcacaaaaagttaccctgttacaaggtcagaagcaacagcagcaacaaatggagatgtaatcagtgggactccagttcagaaacttatgctggtatcagctccatctattctttcttctggcaatggaactgcaattaatatgacacctgcgctgacatctacaggtgtttctgcccagaaattagtttttattaatgccccagttcctagtggtacatcaaccccaactcttgttgcagaatcattaaaacaaactcttcctcctccattgcataaagcatatgttaagactccagagcaaccccaaatagtactgattccgtctacagtgggcacaccaataaaaataaattcatcaccagctgtgtctcagataaaggatgtgaaaattggactaaacataggtcaagcaattgtaaatacttcaggcactgtgccagctataccatcaattaacatattacaaaatgtaaccccaaaaggagaagacaaaagtagcaagggctatattttgccattgtcaacaagtggtaattcagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtggccaacctctacaacatcctctaagaagccctacaaaatttataaactcttttgggaatgcaagttctatacccacagtacatacatcaccacaactcataaacacaactgctaaggttcctgttccacctcctgtaccaacagtatcactgacttcagtaattaagtctccagctactcttttggctaagacatctttggtttctgccatttgccccagtaatcctccactgccaagtagcacttcagtgtttcatttggacccacctgtcaaaaaattgttggttagcccagaaggagccattttgaataccataaatactccagcatctaaggtttcttcactctctccatctctctctcagattgttgtatctgccagtcgaagtcctgcgtctgtcttccctgcttttcagtcgtcgggcttagagaagcctgacagagctgcatcttgaatttagactaaaagagccagtttttaaataatggggcattgttttgactcccataaaaattttcaatgtttattatactgttgaaagcatactatacattgtgtgtgtgtgtgtgtgtgtgtgtgtgtgtgtgtgtgtgttttaatgtatcttttcattagcttgcaacaaggctttgttttcttggggagggaaagatctgttccatttcacttactgttctgaggagggtttcaaggttctgtgtttaaagtcaggatttacctgtctgtagaacataaagtgaacaaagtttgaatagtttagagtaagctagccttttgcacatttacattgacatgtttcttcttgaatttggactgttgcagcatatctatgatatggtattcagtgtcattagtgaaatcttatttttgtttctgtaaaaaaaaaaatacatatatatatttatgcattgtgaaaaatgcagtccatgatgtaaaattgtacatattccagaatccctaacaacctgtactaaatatatgtacaaagaactatgctgtcttatttatgttttgtttacataatgtatagttttttaagtattttagtaattttggaccagtgaactgttagcaacaatgcagaagaatctgcatgtaataaactgagttgctgtatttctttgtttgaa

SEQ ID NO: 6197 - DNA, 2818 bp, Homo sapiens
cagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgcatccttgtctgctctgcgtcacccgagaacacaggcttcgcagcctcgctttctgaaatggtgtgtgccgagtcagattgccgctcagagaaaatacaagcccgttttccctagctgtgccatttggtgctctgccaggctgccgtgcaagggaataccgacgagacgagctgcactgtctctgatttggagccctcaccggagcttgtctttaaaaatgagcaggaagctcatgtatgtttgcatttcagtgagccgggtcctgacctgccgccacccatcacggtcagcgtggtgcatcttaccgaggaggcgcaggcctggattcttttgagtggtgctactgcctaggaagtaacacgtggagaatttccatcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccactccccaaaaccagttgcagcctcaacccacatggggatgtagaaagccgtaaagtccacgctactgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggattttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgatgaaaccccatctctactaaaaatacaaaaaattagctgggcatggtggcaggcacctgtaatcccagttacttgggaggctgaggcaggagaattgcttgaacccaggaggtggaggttgcagtgagctgagattgtgccactgcacttcagcctgggcgacagagtgactctgtcaaaaaggaaaggcaaaaaccggaccctggagctctgtgggccctgattgcaggcccctccctgtgtgatgagggatgagtcagcttggggagccacttggccagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaacctttgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgaacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcg

SEQ ID NO: 6198 - DNA, 66 bp, Homo sapiens
cgaggagcggacagggagcggtttgcgaggtgtgtaatcctagttactcaggaggctgatgcatga

SEQ ID NO: 6199 - DNA, 2179 bp, Homo sapiens
ttaaactgtaaactgagtgcacacatcttaaccctaaatacatacacacatacacacaaccagccacaaaatagtgttatttccttaaatgccaaacactgtctagttctagaagtgaaaaggaccttcttgtcttttcagaagtgtgtgttttgagtatgtaatgagattacctttctgtggctttggagaattaatttcagcgctttattgtcagatcttctctgtaagaaatgtgatagggatttcccattcaatctggaactaagaattcagattgacacttgagctttgtacctcagatagcgtttttcctcatctcctgttatatatcaagcagctgagattggtttttaaaaaagtgaagattgaattgtcttcacacatttattgtgaacttgcagaaaatggaaaggattatgctttaaagacagttggcttggctggatagaaaagatccctctgtcctgtttccctgtcctccttcccacatcgatttaaaaaattagatgcaaatgcaaaatccttaaattatagatttatgataaatttaaattctggtagaatcaaggttttataacatttaaagtgtctgacactaagtgtatataatcttttaagaaacgtcttcttaacagcgcatggtattctgtgactgttcgtgtaccatgaatattcttattgggttctagagttagttactgactcttgaagatgggcatctaatggtcctcctgtggaagtggagagcagctctccactgtttgataacatttaaagccaagggtgaaccactcaagaaacatttggtggttataatatttttttgttgttgttaagtaccatcaataaaactgaaaaatctcttaagtacctgactcctgcagtgatacaactgcagtgataaaacttttagctttttacatcaggggtattaggtattttctcacagaaatagccttttgaggtgaaattcacataacatacaattaaccattgtaaaatgaacaattcagtggcgtgtaagagtatgtttacaatgttgagcaaccatcacctctgtctagttgcaaaatgttttcatcactccaaaagaaactcctttattcatcatagcccaaagttggaagtattttcttgattgggctcttgattacatggatgcatctgagtcattgaattgaagcctaagatgtgcttaatttcactgtgtgtaagtttcacctcagttaacaagagagaacagaacaaaccaaaaatcttaattcttttgaaaaaaagactttctggctgctttattaaagaagccaggggaacaaggttaaaaggaaatcagttagcagtgaccaaggcaagagatgatggtggcttggctgaagatggtgacagtggaggtggtaaggtgatcagattctggatatattttgaaggttgagctaatttggtcagctgatgggcataatggatgtgagggaaagaaagttggaaaggatgatgtgaagatttttaatgggatggaataggtgtttaatgaacagccatttaacaacatcagggtaatttcatcttgtgtatcatcctagagtataaccctgttgtaaagaatgatacacaagacaaacttaccctgatgttgttaaatatatgttagatgaccagttgctttgatttctttgctcaataaacattggattacagctggtttgctgtgtggcatgcctacatggagggaacacactgagccaatgatttcatcatctgggtccctttggtttatatcagtttccaacatgacttgtttgtggggcttgtgggaggggcacatacatcggccccaggattctaacatctcctggtctctgaggttataattttcacttaacattgtcgagttggcattttggttttagtccaatggttcagttctttgaaactgactccagagatggctctgttcattaatagattgttttgttgaccctgtgaggattagtctgtggatcttggaaattcggcaggtgactacaattctagaaggcctcttgtgagatataaggtgttttccttaagtgacatggccctgcgttgcaaagctgagaagtaatatgaaggagcgttttgtaagtttgaatctctataatcaaaaaccagactaatgacacattcgcttttagaactt

SEQ ID NO: 6200 - DNA, 414 bp, Homo sapiens
gcgggagggcggccccatcaacccgcctcgctgcctcccgggaacccgcagctcgctgctctcagcctggagcagctcaagagccaggcccccatggacaccaaaccagcttaccaaaacccgaggcggaaagctgagcattcggtgtctgtacacctggatgagcaggactggaatcctacgatgcacaaaagcctattgggaaatgatcagacgcagagtgaggttcagtcagggacactggaagctggagtagacagggttatttctcagacagtggatccaaaattaaaccacatcctcaggccaccagtggaaggagcaattcatgagtttctggaggccaggaaaaaaagcagcagcgccagctccccgaccagagcccaaagggccaggacactccagctctacccc

SEQ ID NO: 6201 - DNA, 81 bp, Homo sapiens
tgctggggattttattacatattatatttattatatataatatatttatataatatatatattttaaagacaaggtcttat

SEQ ID NO: 6202 - DNA, 105 bp, Homo sapiens
attgttttattactttttatttgcttcctcagcaaattaaatttcaccgtgttagaaaaattccccaaatctacttttctgtgcaaaattcagcatgaaagcctt

SEQ ID NO: 6203 - DNA, 2675 bp, Homo sapiens
acaccgtgaatgtgggatggagaatcagtatcccccgcagcgggctccttttggggctgtgatgttttatagcctggcaagggaatgccaagactccctgagggtctggctcactttatcagggtcccgctgcttgagagcaggagcctgggaggcgaggtgtgtagacgccccagccggggcccctcgaggctgcagtcgggctgaggcattcattcctccgcaggggccccggggcgggagcagcgggagcatggccatgtcggctgcttgctttctcctgctgcctggctctctctgttcccctcctgacccccttctgcctctcctgcgttccccttcctcactcccctccttcaccttcagagccagcggacttctccaggctgcacgcaggcgaggggctggcaattgcaggtcaagcaggctcagctcggagcagcgggaggaaagatttacggttcctccctgccctgcttgatggacaattaaagccgtgcatggttggaggagagcagtgtcgtgaagagtcaggatggtcagaataaatcagtcacctccacttagacggctgagctagactgcttccccgggccttcgaggtgggagccccctggggtgtggctttgaaggttcctgaatggactgttcaagggtttgacatactctgagctccatcagagtcagagcctgaagaccccgggggtctcctcacaaatggggcatgtgctgtagggaattaagggaaaattctggataatgtgtttagagggcgttttgtctccatggtatctggcatttgcaagagcctcaaacctgaatgtttggaagtcaggatagtggacccccacctgcaagcagagcttgtgcacatgtatgtgtgcacaggtgcgtgcatatcagtgcacacatgcacacgtgtagattgtacatgcatgtgcctgtgtgtagagtgtgcacacaggcatgcatgtgcatcctgtatgtgtgcatgtgtgtgcatgtatgtgcacatgcacaagtgtgtttctgcatttgtgtacccacatgtacctgtgtgcgtgcatgagcatatgtgtgtcgtacatgtgtgagcacatgtgtgtgtcatgtattggtactggtgcttgcctcttggacatcgcaggctccacttgtgtctttaaacacacacgcccctctgcaaggctgccgggagctgggcttctgagcatccaccaagccctgcggccgtccttcttcatttgttctgtgtgttatttcagtaccttgaagactctggcaatttcctcaaggaaactttgtctttgtggaaatgagatgccagcactcctcggccctcccactggctaattgatgatatgatcccgcgtgggagacttgccattcctggaaatgctctttatttcctgggccccccctgccccctgcccgccatcgtctgatttctacgagctgctgcatgtgaggtgcagggccaggcatttgctgtgactcagcccatgtgccaggcctttcattaacttggatactacaattatgtgtgccaagagactgcgagggccatttaggatttttctccctttaagaaaatattcctttttccccagccaggtagcccagccctttgcctctgcagctgtggcccaagcactcctcagctctcccggcaccaacctgcaacaaactcttgttggggggctgcggctccgccatggttctgtcggaggtgctcagtgggtggtcaaggcagcctgcccttgggagccgcaggacgtggcctgctgcggtggcttcacggtcacggcacgaatagcagcgtgcgtgcttttgtgcctgtgtgagcacatgtacaccccatcggcacacgcgaggatgacctttggcacagaacacctgctgctgtggcctgcacagagaagggctgaccccaggacagcggctcccattcgcctccaccaaggccagctggacccttcaagggaccctgagaatctccgagcgtgggcagtggggtcgtgtcgtgcgggggtggagttgcacgggtctcctgtgcacctacacatgcgtgctggccagcatattagtatgttcgcaggggtagcctgaccctcttcccccacttaggagatgcgtgcgtggaaacttgcccccgtgggtgtcttgggatgaatatttgggatcctggtggatctggattgcagagtagctgggcactgtaagagttcctgtaaatgttgggtctcctggggagggggaggcatggagcacttctcacttctgtgggtgggtggaaggttggggaggggccacactggctcaagatcaccccacagggagcaacctaatctgaggacagacctgcctgggactctgtggaactgagatgagacacttgcttcccccttcaaaggtcatgagattctggggacacgggctgccttccatacggtacccacaaagctcattaaaagcaccattcagaggcctcgttatctcaaaaaggaaggcaagagtccaacccactaagcaccaaataacaactcaacaactcaaaaacttatttttttaaacttcctggagttgccatggttacttgcacggtccctgcgtctctgttgctctacgtggagctgcttggaggaggaattaaagcctccaaggttcaccccttg

SEQ ID NO: 6204 - DNA, 5438 bp, Homo sapiens
gcggccgcccccggcatgggcaccgcgccgcagggggcctgacccgccgcccgctccgcccccgcctgccatggcggcccgcgcgccccccgccgcacctgcggccgaggagccggggaacccgggcggccccccgcgcaggaagaagtcccgctccggcgcgtccggcctccgccgcgccttcagctggctgcggggcaagcggcgcaagaagaaggcggcgggggccgagggcgccgaaccggccgccccccgggccaagaaggcggaggacaaggccaagagggccaagggcaaaggccgaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 6205 - DNA, 6386 bp, Homo sapiens
gtgcacacattcagttcccgggcatcaccttctctcttcttgccttcttgccgtacaactgaaaaccctaaaaccctccgtgcctacggctcccgggagggtgagggtccaggcagctgggttcagaaggatccacccctggacccgccccactggacgagaagccagagatgccccgggcggggctcataggaccgagtggtggcttctcagttccccaggcagccgtggccattagtggagccgactggctggtcccctggccgtgagccggcttctgaatgatttatgccgccttgaacttgactccagcgtgacaggagtgagaagagccgctcccgctagaggaaagctggaaaccgtactgtgctcaccacataacctctgggtgctggaaatggagtattactactgccccagcctgctgaagctcttgcgctacctctgggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggctacctctcaggagttcatttgtctctctgtctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagatcatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtcgaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagattttttttccctaatctctcataccttaattggaaaaataatcaattaattctatgttaattaggatatacaaagttcaccctccttgaaagtgactagggcaagccctgaagatcttcctcacctccttttatttttctataaccttgtctcctccagcaccacagggaagacaatcacagtgggtcaagagcgaccctctttcacgtgggctctgccatgacctctgagacctgcttatgatcagtgcaatgaagttagaagtaactgatgattgggagcctttgcagatagctgggcaaatgggtgatttacttatccccattctaaatggagtgagctctctttgaggctaagcaaggaggcgttgtatgctagtttctagactttgcctggagacccctttggaaatctgtcttctttttaaactcacttaatatgccttaatcatctgtgtgtaatggagtcatccgctcctcaatctaaccctcctcccctggggctttggctgtcctcaatgagagtttcatgcagaatggaaaatcctctatatgtacaatctctctccccctcatttctcttcctcctcacctccaccacccctttgcacatcagcattttaacagctgatcttttgagaagcctgtatctttttcctcttcagtagatacccttcttcatggtcctttgcctaatcaaacagaggcttttggcctttgaaaatccatgacaaggcctcagaaatcagtgttgtggaggattactccatgccaccggagaaactctggtgaaagagaaacctcgtggtctttaggatgttgggattttgagtgaacctgacctgatagcctcaggattcagggaaaggacaatcagatggcggtgttttccagggggacgcgccaaatcatgtggtttcagacaattgtgtttgcctttgtgcctccctggaagggaggccaactaagggtatcaccaagaagccaaaagagaaataggcatgagcctgtggttttaaactttacaggctgggcaaaggatttagaaagacccttagcatgattttcctaaaagagaccttagctgctccaacctggtgctgatagctgctttgttgatctatgctttaaaatttttctttataatgcccccagatggctcctggaactagtcgtaattgcaaactgtaaaaatccctcctccccagtgtagatatttaaaccagagtaagtgatggggagacattctgtggtctctgaatgtgccttccccctcaccgtgtgttaaaacacaaaagccgaagttccatggcatcatgattccgaggggctggagggataggacccactccacatctaaaggggatctgctttgggctcggtcccattagcgagtgggggactcttgctgtgtgctaagaggctgctaggactcacccagttggaattctgggtgggctcaggaagtttagagccacgtaaaaagctggtaggcatgagtgtgccaggtctttgccagcctgcgtctccttttgcaccccccaatccagagtttgctttcttttgactaaattggctcctgcagggggaagggcagaaagctaggccctctgctctggaaagtcggcctgaggtttccggcaagttaacccttaaaatggacacccctcagcccgccctcccctttggccttcccagaatctccttcagtggttgctctcacacctgtgccataacatcatcttccatgacttggacgggcacttccttgacaattcctattggcatcacacgggctacaaattatgctgttttctaaagaatttgaacttttttttttttcttttcttgagacacggtcttgctctgttggccaggctggaatgcagtggcacaatcatagctcactccagcctccaactcctgggctcaagcaatcctctcatctccacctccagagtagcctagatgacaggcgcacatcaccacgcccagctgatcttttaaatctgttttgtagaaacaggatctcactatattgcccaagctggtcttaaacttggtctcaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttctgggtccttcctcagatctttgagtcacgatagaaaaggagctcgagttctttgtgtaggaaagttaagcttcctgcctgcggtgttcttgcaattgccttaggaattcacaagctctaggagttctgaacggaaggcagacgagaggcactttatccagtcccagaaagaatctctaaccgtgtgactgagaagtcatctagaaaaacttatatttttaatgtaaaaacaaatggggcttaccagacctcacagagtattggacgtctacaagtgcttttatattttgtaactgtaaagaagtttcatatgcacagaagagcagttggaaatctggtcgactgcaataaaacaagatgacctttgcatgtacaaagatgttgcattcagactatgaaaatagcaaataaagctttggtgcaagttgcattggagaa

SEQ ID NO: 6206 - DNA, 1167 bp, Homo sapiens
tgtgagaagtcaaccttcttcaaacatcagaaaagaactcacacagtagagaaaacttttgaatgtagtcatggcaagaaatctttttgccaggagtcccacttcactgagcatcacaggacatgcacaagagagaaaccatgtgaaagtaataaatatgggaaaaccttccatcagaaaagaagctttattcatcatcagagaactcacacaggggagaaaccatatgaatgtaaggaatgtaggaaatccttccatgtgaaaccaaacctcactaaacatcagaaaacacatataggggagaaacctttcaaatgtactgcgtgtggaagaactttcttccagcagtcaaccctaaatgtccatcagggaaagcacacagaagagaaaccctataaatatactgagtgtgagaaatccttctataaatcagtgctaattatacatgagagaactcacactggggagaaaccctgtggatgcaatgaatgtgagaagtccttcgaagtccttacaaccctagttatacaccagagaactcacactggagagaaaccttacaaatgtaatgagtgtgaaaaatcctatctgaacctgaagtcacatcttaatattcatctgagaaatcacacaggaaagagaccccatgtatgtaatgaatgtgggaaggccttttctatgaaatcaaccctaacagtacatcagagaactcatatggggaagccttataaatgtaatgaatgtagaaaatctttctatatgaagtcagccctcagtcagcatcagaggatacatatatacaagaaaccctatgaatgtaagcaatgtggaaaaaccttccagaagtcacacctcattgaacatcagaggacacacccaggggagataccccatgaatgtaataaatgtgggaaatccttctgttataagtcacccttgaccattcaccagagaactcacatagaagagaagccctataaatgtagcaaatctgttacttatttctgtatgaaatcacacctcactgtgcatcagagaccccataccaggaagaacccttttgagtgtaatgaatgcaggaaaatgttttatgtgaagtcaaacctcatcaatcatcagagaactcacacaggggagaaaccatatgaaggcaatacatgtgggaaa

SEQ ID NO: 6207 - DNA, 923 bp, Homo sapiens
cccaaggttgttatatcttcatgtcctcatttcttagggaggtaccttcagaaccaatagtgacccctaacttctctggtggtcggttccatgaaaggcaaaggagtgtgagagaggagtggatggtcaacctcccactgccatggtaacatgggtgctggctgatgggagcagaaaataatttagtgaaagtctgtgggggcagtcacaagatgtctgagaaaactggcgagccagctgctgaaaacagggacaaggaagcctccgtggctggagcccaaatcacactgcagacccagacaccgtgaccaccaccatggactccagagagagcagcttatagtactcaatcagctgccactaccaccatccagaacaccagatgttgtagccatggctgcagcaggaatggatgtcccactgtccctgctcctcggtgtgacttgctcccaagttcagggcaggtccatctgattggctgagtctggaatatctgcctgtgcctcagctgtgagggaggcagggaaagtaagccttttcagcttctgtcgtgggaggtgggctctgcctcctaccaagaatcaaagggtggaggatcttcaaacacaggaaaagaacccggatcctggcacccccaaattttcagagtccatttcagagcataagaaattgagggtccaagatcattcatgtaagaagtttagagggggaagaaaagaatgataaacgaaaagaacagcaatagtaaaggatcttttctttgtttcagtaagatgaagaggcctgagcagtttcgtggaggggaagaaacaggaaaacctcttcaaaagacaaaaagctggcactgcattctctctctgtagcaggacagaactgtctaaagacaagacccctttggccaaaataaaggaacctgaaacatt

SEQ ID NO: 6208 - DNA, 4516 bp, Homo sapiens
gggctcggtagcggcagcttcagggcgcgagcgcgggcggtgccgaccactgcaggtaacagaggcgctgcgagggcagccgcggccctgtggagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaaaa

SEQ ID NO: 6209 - DNA, 7824 bp, Homo sapiens
atgagggccggctggacgcctcgaggcttctctgcctttcacgcttctctccttcctggccggcacccctacctggctcacctgggccccagggaccgaggggccaggattggaagtcgagcgtattcccaaggctgttgcagttgtctttggttgacttacaaaggcaagaaggagggaagcaccaagggggagcttggcccagctgcagtgactgacctggaaatacctagttattcccggggcttcctgccctgcacaccgcgattccctaccacttggtgcaggggacctggatgcttttgtggcactgcagtgattgctggtaatcttggggatctggccaggatagtgggcccctcacatcatgctagtcagcttctcctactccaagaacaggattcaggaaatcatcctacaatggctgaatcactaagtgaaatttctgacagtctggatgttctggaggccggtgatgagggaaagaagaaatgcaaatttaaagcccttaagagcttttttgttaagaagaaggaaaaagaagccgaagatacccaggaagaagaaatgctagaactgagcttgtccagcagcaacattaacatctcttctctgcagcccgttcgggaaaatcaaccaactaaggccagggccaagagcagcatggggagcaaagccctatcccatgatagcatcttcatgttgggtcctgagcctgaaagatcagcaagtaaaatgtttccttctatggatccccagagaggcagacctcagcagagatcccatatttccagaactctgcctaaacctaggagtaaggttcctggagttgtgtctggagccatgtcaggagctgtgcttcaaaatgtgcctacaagtgcagtctgggttgctggccccaagatcactgagaacccaccatcgcgccgacgccgactcagcatcatcccacctgttatccaacctgaaataatttctaagaacttggtagaaatctctctcgatgatgagtcacctaagaatccacaaaagaaggctttaccacataagagtttgacagcgactcagagcttctctgagttatcatctggacctgattgctcacagtccttgactgcatttgccacacttgcctctaccagtagcacccagctgcccattggtttcagcaccccagccaccacccagggctgtttggattcttcagctgctcgccacaaaatgactttaaatccccgcaaacaaaagaagaaccttcaagtgattattcgtggccttccagtgtggttcagtcatttccagggtattttagagggatccctgcagtgtgtcactcagacattagaaactccaaacctggatgaaccacttccagtggaaccaaaggaggaggagccaaaccttccattggtttctgaagaagaaaagagcataaccaaaccaaaagaaatcaacgaaaagaagctgggaatggacagtgcagattcctcaagccagaaacagaacaacaaaactgagatgtatgataagaagacaacagaccaggctccaaacactgatgcttctcggagtcagggctatccaatgtcagcagcatatggaagaagatggagaagaaaaggagcaagtgtttcaggattgagtgggtgtgaattcaaaggaagaagccttaaacaatccagtgaagggtatggcctgggcgatagagctgggtcttcacctaccaataagactgccaggaatgtccctttctcgcacttgtccttagagaaggacaacatggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgatgattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgagggagctggctctgcaaatgaaaaccaacctaaaaagatgttcacttccagtgtccataaacaggagaagacagcacagatgaagccacctaagcctacaaaatcagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagtttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcctgttaagcactgaagaccctattgaaattagagttctacagatgccaaaagctgtactttccatcaggcagatggcaagcttactgccttgatgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataaagccta

SEQ ID NO: 6210 - DNA, 7684 bp, Homo sapiens
acctgctgaaactcagcctgctgggacgagtcttctttcccccttcttgtttctgccatggaagtgtgtggacagccccattcatgatgacatgtgacactactggcttttcccggcagtcacaccccctgacccagggcctgccagcttggcaattgcttctccattcttgaagttcctaacccccatgaatccacaaccataaccatggccacgcgggtcgaggtgggctccataacgcccttgacggccgtgccaggcctgggtgagatgggcaaggaggagaccctgacgaggacctacttcctccaggccggcgaagcctctggggctcccccagcccggatcttggaagcgaagagccccctgcggagcccggcccggttactccctctgccaaggctcgcccccaaacccttctcgaaggagcaggacgtgaaatctcctgtcccgtctctgcggcccagttcgactggaccttccccctctggggggctctctgaggagccagcagcaaaggatctggacaacaggatgcccggcttggtggggcaggaggtgggcagtggggagggcccgaggacgagctcgcccctcttcaacaaggctgtgttcctgcggcccagctccagcaccatgattctcttcgaaaccaccaaaagcggccccgctctggggaaggcggttagtgagggggcggaggaggccaagctaggtgtgtccggctcccggcctgaggtggctgccaagcccgccctgcccacccagaagcctgcggggacccttccccggtcagctcccctgtctcaggacacaaaaccacctgtaccccaagaggaggcaggccaagaccatcctccctcaaaggccagcagtgtggaggacacggcacgcccccttgtggagcccaggcctcgcctgaagagaaggcccgtgtctgccattttcacggagtccattcagcctcagaagccaggccccggcgcagcggccacagtgggcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattgttttcaagttcagcttccagcaacgaagtcaaatatgagaagagtgctgagctgagcggcgagtttcctaaggaaccgagagaaaagcaaaaggaggggcacagtttggatggagcatgcatcccgagaagcccctggaagcctgggacactccgggataagtccaggcagacggagcagaaggttagctctaaccaagaccccgacagctgtcgcggtggaagctcagtggaggccccgtgcccttctgacgtcactccagaggatgaccggagcttccagactgtgtgggccacagtatttgagcaccacgtggagagacacacagtggctgaccagtcgggacgttgtctctccaccacaccccctggtgacatggcccatgcccgtgtctcagaacccaggccgaggcctgagatgggctcttggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagtacgttgcctcgggagaggcctgttcagctgggcggggtggagcagagaaggaggagcctgaaggagatgcccgataccgggggtctctggaaaccggccagttctgccgaaataaatcacagtttcactcctggcttaggcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggcctgtccatcatgcatgaagccagagagaggaggcgagagcagcccaaagggaggcccagccttactggagagaatttggaggccaaaatgggaccctgttggtgggagtcagggactggagacagtcacaaggtgctgccacgggacctggagaaggaggatgccccccaggagaaggagcgaccgctccagcaggtgtcccctgtggcctcggttccctggagaagccacagcttctgcaaagacaggaggagtgggccctttgtggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggctacctctcaggagttcatttgtctctctgtctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagatcatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtcgaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttg

SEQ ID NO: 6211 - DNA, 4622 bp, Homo sapiens
atggaaagtgacaggctaatcatcagtttacccagagtgaagtggacggaagcagcactgaccatggcgtctcagcttcaagaaaaatgtattgcatttattgtagacaacttctccaagattattcagagtgaaaattttgctcttcttttacagtcacaagcaatgagcagcacagccgatctgttggacacaattttaaaagcaattgaagaaaatatcaccactgaaaatagctgctctcttcttatggctctggacacactgctgaactctgacagtacaaaggaaatgggttttacgtgcaagatccaggctctgcgtgataagctgtggatcttcctggttcagtctttctatgctgttcgtcacacagaaagctggaagctgatgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaagaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtaataatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaactaaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcgcctcaaggcgagtggacaattctggaactggaaactcagcattaagtgttaacattttggaaaaatttatgccactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtcc

SEQ ID NO: 6212 - DNA, 366 bp, Homo sapiens
agccacatcatgctcaacaatggcaccaagacggacatgctagggctaggcacctggaagtcccctccaggccaggtggccgaggctgtgaaggtagcaatcaacactgtataccgccacatcgactgcagccacgtgcaccagaacaaggaccaggagcagctcaaggagcaggtggtgaggcgtgagtggctcttcatcatcagcaagccatggggcatatgccacaggaagtgcctggtgagaggatcctgccgaaaggtgctcagtggcctggagctggactacctggacctccaccttattcactggccaacaggctgtcatcctgggaaggaattttcctttttagatgaatcaggcaac

SEQ ID NO: 6213 - DNA, 3611 bp, Homo sapiens
cgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactct

SEQ ID NO: 6214 - DNA, 660 bp, Homo sapiens
ctggaaaaggaggagaagaaccccaacacagagttctacttgaagaacctggtgctgaccacgttgaacctcttcgttgggggcactgagaccgtcagcaccaccctgcactacggcttcctgctgctcatgaagcacccagaggtggaggcaaaggtccatgagattgacagagtgatcggcaagaaccagcagcccaagtttgaggaccgggccaagacgctctacacagaggcagtgatccatgagatccaaagatttggagacttgctccccatgggtgtgtcccgcagggtcaagaaggacaccaagtttcgggatttcttcctctccaagggcatagaagtgttccctatgctgggctccgtgctgagagacctcaggttcttctccaacccccgggacttcaatccccagcacttcctgggtgagaaggggcagtttaagaagcgtgatgcttttgtgcccttctccatcagaaggcggaactgtttcagagaaggcctggccagaatggagctctttctctacctcaccaccatcatgcagaacttccgcttcaaatcgcggcagtcgcctaaggacattgttgtgtcccccaaacacgtgggctttgtcacaatcccacgaaactacaccaagtgctacttgccttgctga

SEQ ID NO: 6215 - DNA, 549 bp, Homo sapiens
tgtaacaggcttaccctaactgatcaatcaacctcgtgacactgtgctctgtaaccttgtgataatgtaccttatgacattcttcccctgcccgcaataaacggctcctaactgtaactttccggtgcttacctctaactgataaaactagctccaacccaccaccctccactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgaaatccaacaccggtcacggactcttcttggggagacagccttccttcagtgttcggtcaatgcccgggacgcccgccttggccatttgccagccacacaacccaggacctccaatgggg

SEQ ID NO: 6216 - DNA, 375 bp, Homo sapiens
atgactcttaacgagcatgccgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcatggcccgttctcaatgagctgttgggtacacctcccagatggggtggtggccgggcagaggggctcctcacttcccagtag

SEQ ID NO: 6217 - DNA, 670 bp, Homo sapiens
ctgggcattagtctgggcattgaccaggacagcgctgcttttttattatctacaatggccattgcagaagttttcaggaggatcggagctggttttgtcctcaacagagagcccattcgtgtgatttacattgagctcatctgcgtcatcttattgactgtgtctctgtttgcctttacttttgctagggaattctggggtctaatgtcatgtagcgtattttttgggtttatggttggaacaacaggagggacccacattccactgcttgctgaggatgatgttgtgggcattgagaagatgtcttctgcagctggggtctacatcttcattcagagcatagcaggactggctggaccaccccttgcgggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatgggg

SEQ ID NO: 6218 - DNA, 2196 bp, Homo sapiens
ctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacc

SEQ ID NO: 6219 - DNA, 96 bp, Homo sapiens
gacacagagaactcccctggggagctctcactctcccggaaaactgaggcacagagaggtgaagcaatacacccacaatcacacagcagagatggt

SEQ ID NO: 6220 - DNA, 2865 bp, Homo sapiens
ggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcaggtaaaatgccatttcaatagtggtagttcatttttatgtactaaaacaattatctgtgatcttataagcaaaaacaaagacatttaaaaatattcaaattatttctatgttatggttaattcccactcaggacatgtaaatgtgcgacaagacgagtattacctgtatataaactccattgcattcatcaaaatttataatctgttatataggctctttgtgacaggaagcaattatattaggaagacagcttcagattctggttctaagctttcatgtgggagttacaaacttgtggccaatttagccgcctacagacaagtgttgggtagcccacactacgtttttgttttctaattgatttctttgttgttttttgtttttttctgagacagattcttgctctttgcccaggttggagtgtagtggcacgatcttggctcactgcaacctctgccttctgggttcaagtgattcttgtgtctcagcctcccgagtagctgggactacaggcacccgccaccatacccagctaatttttgtaattttagtgaagatggggtttcaccattttggccaggctggtcttgaactcctgatctccagtgatttgcccgccttggcctcccaaagtgttgaggttgcaggtgtgagccaccatgcctggcctctaattgattttttaatgtcttagatggagcatgcaatccctggttcttcctattgtgttaaattcctggcttgcttaggctccggtaagtagtttgggaaccgaagcttgattcttgtccatgaacttgttaatgcttcactgaaattgttaatcatcatcaaataaatatttaagcacttattcaaagataaaaataatgggattttcaaaattatcttcaagtttagcaaattatgatgtgaacgttatgaataatacttttaaattgctcactttaagcccttagcagttttgtgttttacagggctataatacatttcagaacctcatttaagcatttgagaagaaattagctaatgtttatctgcagggcatagttttgagatcataaaggccgacaatatttggtcaaattaactttgttcaggtttttataatatattagcttcaacttggcattgtcagtgactgaaaatctgtttgtaggataggtaaaactgcatggttctctcgcctgtggtgcatgtcctattttagcatttttgctgataatagttatttggtcttgcggccagcagatattttgctgtttattatagataacatggaatctggccagtcttttgaagccattatgtaaaacttaattatgtaaagccattatgtaaagattaaaataattttaatcatggtatttactttcctttgttagggtctctttgcttctgcttctgtattctttaatgggtatttgctttttaaaaaatgtgctgagattgtgctaaaaattgtgattcaaattgataacttactaatataaagtggcacttctggatgggagaaggcagcattaacatagtgattacataatccactcttaggctgtactacttccacattgtaaaatggagtaaagaaaatacctactttaggagattattttgataattaaatgagagaatgcttagtgcatatattgcagttatcatcgtgcttggcacctacaaagcactaataaagaggttagctgtta

SEQ ID NO: 6221 - DNA, 1114 bp, Homo sapiens
acgcgcgcctccaggagagacgcctccttcttaagtccccggcccctcccgccaacggtcaccgggattcctggaagagacggggatttgggggaaacggagagggttctgcgaggagacgggaccagtgagacaggcaggaccgggtggaggcgtctctacgagcaggagggcaaggaagatggggcaagacgcggggaggctgcagaggaggagcagggtggggtttggagagaatggagcctgcagaaaggagcggcagaaactggcgctggaaggctcaaaaaaggggccctggaaaggacggagcggggacaggaaagggaattccaaggggcaggaggagctgggcagaggagcccgtgtaaacacagagtggcccatgcccaggatgagggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatggcaagagccttgccctcaccccacaccttcccagcctgcttcccctgggacacagccgttgctcacttcctatctggaccccagaggcctcagcctgcatcctcacccagacagagcagttctcaaggatcctccctgtgcc

SEQ ID NO: 6222 - DNA, 1673 bp, Homo sapiens
gcaacacaaaacttaaaacacagtattatttagcattcggatgtacatgaactaggatacttatgagaaacccaactgcgtcaaaagtatgacattgtggaaaaaatgaactcaaatatatcaaaatgcacaaagcactagtcttcctccattaccgcttagaaagatatgattgtttctccatttacaaaatagaatcaggacaatttaaattttttatattttgcatgcaaaacactgcaattgcttatttatgtaggagggcactctcaccagcttcttctatacacaattgagtatacaatattgcatggaagaaaacagcagctcaactgaaatattagaaaaaaaaatcaaacagatacatacagatttaaaatccagtacttgggaaaagatatcaatgaataaaaggcctacttgtttgcagcttccacacactgcacctacctactacctctcttccatgcttaactgggtttagaaaggtgagctatgcgtagaagaactacttgggatattcaagtgctgtatttgaacgataagcctatagataacagtctgaagctgcaagggagactttgttagtacactactataaacaggtaaactacctgtttgtacttgatatagtgcatatgaaatgactgatttaatacaaaactacagaacatgcaaaattttttctgagatgttaagtattacttcagtggagaacaaaacttacttaacctttcgctaatgcatgtagtaccagaaagcaaacatggttttagcttcctttactcaaaatatgaacattaagtgttgtgaatttgtctgccaagtggttcagaaatacattataaataacctagttaaaaaaagaaactgtgaaccatcttggtcagtctattctattctatgtttatatgttattttctcaagcaatcgcttcataattatagggtttacaaaaaggtcgagaaagaaaagcgaaggcgaaatagcctctactgcattacaagcaacatcaggataaactgtacaaagaatcacatggtttccataccatgaatgtagaaagcagaccaggtttaggaatgataggacaatgcactctctgcaatagccaactacaacaaaacactttgaaagtaaaggtgaaaattatataaagggaaaaattcaagcctttaaatagcattatgtcaagaggtgaaaacaaaggtatcaaaacaccctgttgcactacgttgatagttatagactgatagagtgccctccattttcaatgaggatgtctccatattttagttcagtgatgtaataaagtactgattactgatttttaacccaactcttaataggctgcattaagacagcaaaattagccaaatacaacaaagtatttaaaccactactttgtgattgttttcttggatgtaggaaaattacagggttaggctagttgtaagtgaaaaagccacaggattaaaaaaaggactcatggggaaaaatacacacacacacccacacacacctatacacccacacacccacatgccaaccaaccaaccaaccagcaactgatcagtaaaacttgttattaaccagggtgactgttcttgataatagattaaccctgctgtagaatgctatgttgcctttaaaaaccaattcaattattatcc

SEQ ID NO: 6223 - DNA, 153 bp, Homo sapiens
ctcaagcctggtttcttcctttccttcttcatctccatgacttaccttttttcttttttcttcttcgggaaatcctttaggtcattactaggtgagggtttctctctctgtctctctctctctctcacacacacacacacacacacacactca

SEQ ID NO: 6224 - DNA, 438 bp, Homo sapiens
ggggagtctgaagatgtgactcaattcctgcaatctcataagaaaactttaactaatgagaagttgtttcttatggacgggaaaagaacgtggtttcttgagatggaatctactcctggtgaagatgctatgaacactgtcaaaatgacaacaaaggatttaaaatatgacagaagcttaattgataaagcagggtttgagaggactgactccaattttgaaagaagtcatactgtgggtaaaatgctatcaaatagcatcatgtgctatagagacatcttttatgaaagggagagtcaactaatgcagcaaacttcattattatcttatgaaattgcgatagccaccccaaccttcagtaactactaccctgattggtcagcacccatcaacattgtggcaagaccctctaccagcaaaaagattatgacttgctga

SEQ ID NO: 6225 - DNA, 5450 bp, Homo sapiens
gccagtgtattcacactccgtgtgtgtgtggtgtgtctgtctcagtactactgtaattgatgaggcaggggctccctggccatcccagcagtgtcaccatcttttgggtagaacagcagacacagagatggcccactgtggacagttaactaactggctctgtttagcatgggaaaggaaggagagtcctgattttctttcaatattcctcaggtatattgatctgacccccaagttacataagatctgcagtgataaaaccattacccaaaaaactcactgtcttttaccacttatatcctcagcattatcatcaattgtcttaatacaaggttggtggcaaaaaacggctcacaagtatgcatacaaaggggccaaacacattgagcagcaaaacccccaaagcagacaccgcccgagacccgctggagcgcttccgcaaatctcgcgagatagcaggcagcgatgccttttgctccggtttctcgtgagaccccggggcttcagcttctcgtttgcggagcccgcggcggcgtttcctggggcaacagcaatggcggcctcgctgtccgagcggctcttctcgctggagctgctggtggactgggtgcgtttggaagcccggctgctgccgtcccccgctgccgcagtggagcaggaggaggaagaggaggaaaaggagcagggggaggcctcgtcgccgcgcggtctgtgccccgccgtggccttccgcctgctggacttccccacgctgttggtttaccctcctgacggccccggcgctcccgccgccgaaccgtggcccggtgtcatccgcttcggtcgcggcaagtcctgcctcttccgcctgcagcctgctaccctgcactgccggctcctgcggaccccgcttgccaccttgctgctgcagctgccccctgggcgcccgacgcccaccccacagctcctgggggcctgcgacatttcgctggccaccgcagcgcacagggtcgtggggccggccgcctccggatgctcccaccgtcaccggggacgtttccccctgcataatcgagtgggcgagcggactggggacattgcactggcctaccgcctgactgacctgggaagccgcctgctgagccaacttgagcggcccctcaccttcacccgcacaggaggaggagcggaggtcagtccccaaacccagcaggaaagacagcagctgcagcagccagcctcacagccaagcccaaaagaggctgataagccgctgggggagttagaaatcccagaggcacagaaggatttgaaggaaatggttaaaagtaaggccgaatgtgataatgtgggttctgtggagaatggcaaaaccaattctgttgttacatgttcaggtgctggcaatgggagaaatgttagctccctaaatgaggaagtcacagaattggacatggagaccaatatattttgccctcctcctttgtattacactaacttgacccaagaaaaaccgccccctgcacaggctaaaatcaccattgagcctcaaatgaatgcacctgaggaaatggatgatgcttctcctgaaaaaaagcgtgtaaatcccccagcacacaggagttgtctaaagcatccaagttctgcagcacacgaacatcctccaatgcttgtaaatcctccacatattcagaatataggagcaactaatcaaacatgtcaaactgaacaaaatcgaattaatacaataaggcagttgcctttgttaaatgctttgttagttgagttgtccttgttatatgaccaacctgtgacaagtcctgctcatatacatcctcacctagcctggttatataggactgaggataagaagtcacccgaatcttctgccaaatccacatgccggtctgaagccaagaaggataagcgttctgtggggggatgtgaaaagtcagtgagtcttcagtataaaaagaaccaaattgaaaactataaggaagataaatattctgaaaagagcagtggtgccctccataaaagagttccaaaagggaggctactttatggcttaacaaatacactaagactacgtttaaagctgacaaatcctgatatgttggtggtacatgaaaaaagagaactatatagaaaaagacaatcacaaatgttgggtacaaaattcagaattccgtcatccaaagttaaactattaagctctgcagaacaaagtcagaagccacaactgcctgaagataagtatttagattcagatgcatctttcactgaaaatagtgatacctcaagacaaatcagtggagtttttgatgagcccagcacaagtaaagaaactaaactgaaatatgcaactgaaaaaaagacagttgattgtagtaaaaatagaatcaataatgtttcattggaagaagttgtgagtcctgcaaattccattattccagaaaggcttacccctacaaatattctgggaggaaatgtggaaatgaaaatccaaagtccatgtgttttccaacaggatgctgttgttgacagaattgtagataaggaaatagatattagacaggtcaaaaccacagataatgacattcttatggctgatataagtgacaagagaacaggtaaaaatagttgctatgaaaacatctcagaactgaagtattcagatgatttgtctagcccttgctattctgaagatttctgtaccagtgaggacaccagcagaagtttcaaagctcatgatagcagttcaaggacagaaaatccaaaacatagtcaatatacaagcaagtctagtgacacaggagtgtccaaaaagaaaaatagtagtgacaggagttctatccttagcccacctttttcagccgggtcacctgtacactcatacagaaaatttcatatttcaaagactcaggataaaagtttggaggaagcatctagtatctctgctagtgatttatcttcaacacattggactgaacaaaaagaaaaccagatagatcaaaatagtatgcacaattctgaaattacaaagagagctcaagacatctctgttaaaacaagaagtagttggaaatctttagaaaaaagccagtcaccacaaacatcccaggtgagttcttacctgccttcaaatgtgtccgaacttaatgtcctggatagcagtacatcagatcactttgaagaaggcaatgatgatgttggttcactaaatatttccaagcaatgcaaagatatttgtgaattagtaataaataaacttccaggatacacaatgtaaaaatacatgcttttaaaaaactttcaaggacctatgtgtactgttagtgaaaaaaattttaaagctgttttagttcatgaattatgtgaataattttttaaagaaatatgaattaacgttattcctttgatgtttaaatggtattttaccattaaatctgataatattgattattaaatcatataaacagatttctttttaaattgtttaatcataagaataaaagtgtgtctttctaaattgtctctcttaaagtgtctagtctacagtattgatcattctaaagctgacttcatgcacaccactgaaaaagaaggctagttagtaaggacagcctcaaattttaattggaacaaattatttaacaaatatagaagacttactgtgttagatgcagaaaggtgcagaatctatttatgatagagccctgctgttttaaaagcttacagttgtatgtagataagaagtcttccttgacatatacatatcccatatccccaataggtgaagttgcttttatatgctctcatagtgccctgcaccttttgtttataagccacaatttgtgtgattacttgattaaagtttatcttccactaggcttcagttgtgtgatgggatcatatttgttttacacatcagtgcatttttgtatctagcacaattcctggcatgtggctgcagtgcaataaaaacatttgttgaaaaaaacgaagcccaggcatttaaaatacctaatgggagggtttagaattaagcagcaaaaataagcagattccctaaaataaacctgcagaaaatccttattggaaatatatttgactgtaatatttctgttttgcttggtataaatagccttcaggtgttctctgaaatatttggaaagggaaacttaagaaggtatcttttatacagtttctgatataggagttcagtttcttgtcatttcagtttgttcaatggttatttttagtgtatggaactttgtttttatgaaatccagtgataatttataatttattccattggttttatatttagactttattctgtgttcaaatatttacatatattttcttctagctgtgttatactttaatttttagactttttaatatatctaacgtttttgaatgtatgaagtgaggttctaatttcctttctttaaaggtaattaattatataggtattctgaatgatcataatactagaatatagatagatggtaaaaagagagaagaggatgttacattttggggagcaatatgaataaaagagtgatgggaatgagcctgatatatttatgggacaatttaaaatattatcttgaatagaatgatccactcatgctacagagtggtagaaaggacatttgttgagtaaggaaaatgccagattacagagagcctcaaatgctaagtataataatagaattctaagcaataggaataacagattattttaggttataaatgagcactagtaagtagtcatgacattttgaatattttaaattattgaaaataataagcagagaaattatatcagttaaagttttgagatatgaaaggtttctgtggctagtggctatgatcttaatttttctaaaatataaagcatatagtataacatttcacaaaatcaaaatattgtaatgccaggtattgtaactagatgtttaatgatgtgaactgtgtaaattgtttaatagcaatttgtcattactatggaagagacaataaaaatataagcaatatcagaatcatcaaagaaataattccttataaaccaacgttttatttggtagagagtaagtcattgtctgtggtaagaataggtaaaatgattaatttagcaagtctaaggtacaacaagaccaaaaaactaatgcactttaaattacaaagctgagtagctgaatccgcttctctttgagttaatccatgaatacttatttctagaattgtgataattgtttcttctagtctaattctagtgaaaatatctgttttcatgtatttagtccttcctattacattctacaaattctactccatgttttaattctacaatctataagcttattttaaaagaattttgtaatagatactattcatggagccttatttatctccttagttgcttaaaattattgaaacatgaaatagtatttcaagtc

SEQ ID NO: 6226 - DNA, 561 bp, Homo sapiens
agaagtctcttgaaagaactagagaacactaaggaccacactctcctgctggaaaagcgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccatagagtcccttgggtctccatcatccctgagctcctcccaggcatcagagcctctgtgtcccctgaagcacccttcacaccggccacctgcgagcaccctatcaccaaacctgaccagctccacagaatccttggggcttctttctagggagaccccacatgcaggcaggcggaggcaggggtcccgctttcctcagcctggatgtgccaacgctgctggacgcacaagacaccaaaatcccagacactcccatggacaccgaatatccgacatccacgaacaattgggaatctcctga

SEQ ID NO: 6227 - DNA, 2597 bp, Homo sapiens
attcagcgtttgggtgaagacggaggcgggttctggacagacgtacgctgtcagggagtgtttactttgcctccacttctgttcctccccgccctggtgctgctccgggtcacatactcgtcctgagccggcttcagcctctccgcgcagaagtgtcccggagccatggccgagtactcttatgcgaagtctaccaagcttgtgctcaagggaaccaagacgaagaggtgggtcctgcacctccggcgggagcctcctcagttcttttcggacgcactccacccccctcgaatccggtggaagccgtggcgcggagagccggctttgtggcctcccaggcttcgccctggcccctgtccgggctggacggaggccggaccgcagttcctggcgcctgtgcagagaggggcagcctcccgcactgacgaccctggaaacaggatagacgggcgggtgacccgtggccccgtacccacgagtttcagtcctctgaggcatctctgcaggcctctgcctgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatccactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagagcacaaacttaaaataagtaaagaagacagtaaaattcttaaaaaggctcagaaagatggatttttgcaagagacgcttctggacagagtcgcagtcatagcctgccttcatctctgaagggaccaggtaacacacggagtgccttggcagcctcgtcattgcatgcaatcttcacagacaatatctcactgcagccacctttctacaggagtacaggtgtgacattatactgatgacatcattctcagagaaaattcattttacacactgaagatacacagacacaaagagccttatacaaagggaatggacctttccccaacacagtagtgcaaggccctgccactttgcttcaattcctgaaaattccttggtaaacttggggctgctctattcctgacagtttcaagaaatagttattcatcctctcagcatccacaacgttaatacaagcccaacattctttaatttgtgttttgttttttggagacatagtcttgctctgtcacacaggctggtatgaagtggcatgatctcagctcactgcagccttgacctcccaacctcaagcaattctcccatttcagctttccaagtagctaggactacaggtgtgtgccatgacactcagctaattttgtttatttttttgtagagaaaagctctcgctatgttacccgggctggtctcgaactcctgggctcaagagatcctctggcctcggcctcccaaagttctgggattacaggtgtgagtccatgtgcccagccctttaattctttacttggggttcaggtgactacacatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacactgtagatgctttagcaacctcttcccatgcctccgaagtatctggtttgcatgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatctttacacgatgcaattctcatctgcaggaagcactggcctccttcatccttaggctacagtgctgacactggcctccttcatcctcagactgtggtgccagatgtcacccctctgcgaggcccttgggatcgactgagtgaccagcagtgaagtttgtcagccttctgaatggatgccatgatcagatgtgatggagctcagtgggattctgctgctttccctcccttagctaggatgtccctgataaaggatgacacacaagcctcagcacaactggccaaacttgaggtggtcatcatagcactgatgctgggccaacaattaaccccacttgtacctttttacaaactttttgacaattgccaagaattgtccagcttccctccccattgaattaaatacacttcttgtctcatgg

SEQ ID NO: 6228 - DNA, 2314 bp, Homo sapiens
ctccaagcagatctcttcaactacctgtgaaaactgatgtgatgaaaaggggaatttgaaggagccattccagaagacagggcgaaaactgaagtgcaatcagggccaagaaaaacagaaatagcaggacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggacgggggtggaaggccaccttcgatgggtgcatcctccacgatgacctgctaacaaaggtgcatggatttcagagtctgattggcctacaacagcatttggcttgtggagacagtggttccctgatgaaaaactgccatgatgtaaggaagagcctgtcagagcgaggctggggtgctgcgtgttggggaggtggaggtgtggcttcccgggagaagctccacccgctggctgagtctggcacataaaccagtctgtgaggggatggatgtgggtgtaatgggggcaattacagtaggaaggagcccacgtggagcctgcattctctgggacagggcattactgcattctctgggacaggctaaggcccagatcctaccttcccaggtggctggatgggtcatagatgtatgaaccggtcccctcattttctgattgccctgtgcttaacgtttctgtacctttactgaggctctttcctccaactccagtgcccagaccccccttctcctgaacatgaatgcctgtccatggaaattcgagtctctctctctcacccaggctggagtgcagtgatgcaatctcaactcactgcaacctctgcctcccaggttcaagtgattcttgtgcctcagcctctggagtatctaggatcacaggtgcgtgccaccatgtctggctaatgttttgtatttatagtagagatgggtttcgacatattggccaggctggtcttgatctcctggcctcaaagtgatctacccacctgggcctcccaaattgctgggattacagttgtgagccaccacacccagcctgtccctgaaattctaatgaaatgtgcgataaagttgttttgtttttctttttgttttcccttcttggcaaagcctggtgtttctattttagtggatttgcctggcactgaggactgctatggtggtcttcagaggctcctggtattgactgcttgtgaaaccgcttttgcaaaattatgactgagacagtgaaagagatctaacttaaccgacccaatcttgcttctaacctccaaattgtccttattcattcctgagcatagcctgaactaactttgggagaagcttagtttatattttattttatagtttaaaacaaagatgttaacagccctttcccaaggcagacttccttcttgcctggggactaggttgcctttggaggactaacattagccacgagattagaaattatgggctgggcctcgtggctcacccctgtaatcccagcactttgggaggccacggcaggtagatcacctgaggtcaggagttcaagaccagcctggccaacgtggtgaaaccccatctctactaaagaatacaaaaattagccggttatggtggcacatgcctatactgccagctacttgggaagctgaggtgggaggatcgcttgaacctgggaggcggcgtggaggttgcagtgagccaggatcttgccactgcactccagcttgggcgacagagtgagactctgtctcaaaaaaaaaaagtttagaaattatgctttaggagtcatgcagctggaggctacaagattctgaccctccctaaactgctcctaagatcagtgcttgagatattttgcagaccctgcacttgatggatcagctggcaccacccagactgattaactggctcatgtgatcttgtggtccccacccaggaacttaatcagcacaaggagacagcttcaactccctatgatttcatccctgaccaatcagcactcctgggctcactggcttccccctacccaccaagttgtccttaaaaagtctgctccccaaatgctcgggtagactgatttgggtaataataaaactccggtctccc

SEQ ID NO: 6229 - DNA, 1353 bp, Homo sapiens
acacagcgacgtagaggtgactggaggtatatacttgtcctcacctggatcatgctgatgtggccccaaccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagcgggaggagaagatacaggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgggagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgcgggagcaggaagtgaggctgcggcagcaggaggagaagatgcaggaacactag

SEQ ID NO: 6230 - DNA, 3651 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagtcaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 6231 - DNA, 1718 bp, Homo sapiens
agaaggggtgggtctctcacctgttcctggctcccactaactttgaggagttcacagccccagccactcctccccactgcagccagtgtctccgtagcaactgctccacatgggccactgctgccatcatagagcggtccttgcaggtgcctttcttgtacctcagcactcctgggggtcattagaagccctagcaacactgctcaccacactatagctccagaggccctagcagtcctgctcccacagatcccacttctgacaccatctattaaaagaaaatcttcagctgaattaaatttaaaggaacttaattgagcaatgaatgattcacgaatcaggcagcccccagaatcacagcagattcagtgagactccagcacagctacatggtggaagatttatagacaataaagggaacgtgatgtacagaaatctgaagtgaggagtgaggtccagaagcaactgggtccgttacagttctcagcagtgaggtccagaaacaactggactggttacagtgctcagcatttgccttatttgaacacagctgaacactcagtagtgtgtgagtggcagaagtttggctgttgggattggccaggactcagctatagttacaggtgcatactccaaagttaggttatcagtctttctacctattaagttaggttgcagtttgtccacagggactcaaatctagaagtacagagtccttcccaggccatatttagttcactgtaacagttcctattatgacctcactgacagttctttttctctgaattttcctttcttctcaacagcttgtccaaatgttccattggtccctgttcatcccgccctgcagctctccttgactgattctgccctttgtggtttgcagtcctgtttctctacagcttggaccccttcaatctttccatcataggtttaactctctgttgaattcttatttgtagctacgcaaatgttaccttaagctaaaaaaattcaaagtgaaagccacatcctcctctcttcccttatgtgtatggtattactaccatgcagccagtgacccaaaatgggattttttctgggcttttcttgcttagattcaggctcatctggtgtcaagccttgttacttttgtttccttgttcttttatttttaattttttttcttttgagacagagtttcactcttgttgcccaggctagagtgcagtggtgtgatcccggctcactgcagcctccacctcccgggttcaagcaattctcctgcctcagctcctgagtagctggtattacaggcatttgccaccacgcctggctaattttgtatttttagtagagatggggtttctctgttttgatcagggtggtctcgagctcccgacctcaggtgatctgcccacctcggcctcccaaagtgctgggattacaggcctgagccaccgtgcctggcctgcttgttgttttcatctcatcctgatttctgaatacaggagaggagctgagttggtgttcactaacaagcacagaagctttgttacatttacagtgtcattcttggcaaaacctgaatggtatgtttgtggggtgatgaggttcagtcccctgtgacctgtgcatctggccaacactgtggtgacatccttaggaatccatggggagagacaaagcattcaggagttagtgggtcacgtttgacaagggccaataaagaaatatgc

SEQ ID NO: 6232 - DNA, 2176 bp, Homo sapiens
agctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatc

SEQ ID NO: 6233 - DNA, 1455 bp, Homo sapiens
aagctgagcccagggaggctttgaggtacacagggtcccttggggggcctgagagcagccatgaggaggcacagtgagacagatgtggaagagcagacccaggagctgaagaccatcactcagctccaggagcagtgtcgggcactccagatccaaggggtgaaagagaatatggaccagaacaaggccacgctggccctcctgcgcagcaacatccgccgcggggcccaggactgggctttggccaagaagtatgaccagtggaccatctccaaggcctgcgggaaaaacttgcctttgcgactggcgcactgccgcagcaccatggaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtcaagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggaggcaggcgcagcggctaatcgaggggaagctcaaggcggccaagaaaaagaagaagtag

SEQ ID NO: 6234 - DNA, 378 bp, Homo sapiens
agtggcagtcctgctgggcttttaaagggtgactcgaagaagccttcccaaaggcgtgtgaaaaggcagccctactctactaccaaggtgacgtcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctagaataagtataggggaa

SEQ ID NO: 6235 - DNA, 1371 bp, Homo sapiens
acacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcaaaccatacgaatccttacatgtcagaaaactgagcttcagatggcactttactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagcgggaggagaagatacaggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgggagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgcgggagcaggaagtgaggctgcggcagcaggaggagaagatgcaggaacactag

SEQ ID NO: 6236 - DNA, 594 bp, Homo sapiens
ccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaa

SEQ ID NO: 6237 - DNA, 7771 bp, Homo sapiens
acgtaaggcgcaggccagggccgcccggcgctcggcagccgcccgcagcccctcggagccagaggagaggcgcccccgccggccgccgcgccgcccggcagcctcggcaggttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacaggctgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttacagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacattttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacagtttgttgtttttatttctcatagcaaagcttcttttgtaaagaactccagcttccttttactcatgagcatccgtggaagagcaagtgcccaggttacatttgttctagatggaggtcatttagctctcattgcagacactgctgaaaacattgtgcagctttgctagggaagaaagtggtgtggcctgctgagaaatcagcggctcctccccatctcacccccagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattcaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatctgtaaacatgtatgaggggacttttaaaagttcatggaaaatggaattaaaagaaaaataaaaaaatataaactttatttctc

SEQ ID NO: 6238 - DNA, 363 bp, Homo sapiens
atggagtttgtgctgagctgggttttccttgttgctatattaaaaggtgtccagtgtgaggttcagctggtgcagtctgggggaggcttggtacatcctggggggtccctgagactctcctgtgcaggctctggattcaccttcagtagctatgctatgcactgggttcgccaggctccaggaaaaggtctggagtgggtatcagctattggtactggtggtggcacatactatgcagactccgtgaagggccgattcaccatctccagagacaatgccaagaactccttgtatcttcaaatgaacagcctgagagccgaggacatggctgtgtattactgtgcaagagacacagtgagggga

SEQ ID NO: 6239 - DNA, 777 bp, Homo sapiens
agaagtctcttgaaagaactagagaacactaaggaccacactctcctgctggaaaagcgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccatagagtcccttgggtctccatcatccctgagctcctcccaggcatcagagcctctgtgtcccctgaagcacccttcacaccggccacctgcgagcaccctatcaccaaacctgaccagctccacagaatccttggggtatctgtcatccctcagctcctctcagccaccagagcctttgcgtcccctggaatgtccttcacacaagccatgtgggcgttcccttccccgacgacggaatcctggctgggtgtcctggtccgactccatgcaggctgattccgaaactgacgccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagtacccattcaagcaccctaatcttcccacccacctaccaaaggcttctttctag

SEQ ID NO: 6240 - DNA, 3720 bp, Homo sapiens
gattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcaaaggaggctggtgcagggagacagcaaactgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaagacagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccgtcttggaccaaggaagaaatatcctcaatgaaaccaaaagaattcaccatctctcctgactgtggcaccattcgcccccagggatttgctgctatcagggtgacattatgctccaacactgtacagaaatacgagctggcactcgtggtggacgtggagggcatcggagaagaggtgctggcgctcttaattgcagcaaggtgtgttgtacctgccctccacctggtcaatacagaggtggactttgggcactgcttcctgaagtacccgtatgagaaaacactccagcttgccgatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggaaacctaacagtatcctgaaacctgattaccagcccttggccgtaaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctgaacaactgggtggcagaagaaattctagcaattaagtatgtggaacaccctcagatagacagcctggacctgcgcggagaagtgcattaccccaacctcagctttgagacaaaggagctggattttggctgcatcctgaacgatactgagctcattcgctacgttaccatcaccaactgcagtccgttggttgtgaagtttcgctggttcttcttggtgaatgatgaggaaaatcagataaggtttgtgacattgccgaagaagccctacagtgccccactgtcccagatggagtccatcccagcaacctcagaggctgccagcccaccagcaatcctagttacagtagagtcccccgagatggatttaaatgattttgttaagaaataaaaattagctctactgaaatagaaagaatatactcaagccagagccaggtggaggatcaggaatccctacagacctgtgaacagaatgagatgctttccattgggatagaagaagtgtttgatattttgcccctgtttggagtgttgcagccacacagtagccaccaaatatcgttcaccttctatggacacgctaacatcattgcacaagctaaagctctgtgtgaagtggaagaaggacccacctacgaaataacactgaagggagaggcgtccctggtcaactattcctttgacaccaaggatattcactacggattacagctgtttgaccatgtcacagagagggaaatcacgctgacgaacatggggaaagttggctttgagttcaaggttctgactgaccaccagtcttctccagacaaccttctccctggagtgccactaatcctgcctgtgtctgtaagtaaatggtgggaggggcctgaattcaaacctacgagccccactccgaagcaggtgagtattcacgaccaggattacaagtgtgattttttctttttgttaaaactaaagaactctcagaagc

SEQ ID NO: 6241 - DNA, 291 bp, Homo sapiens
gaggttcagctggtgcagtctgggggaggcttggtacagcctggggggtccctgagactctcctgtgcaggctctggattcaccttcagtagctatgctatgcactgggttcgccaggctccaggaaaaggtctggagtgggtatcagctattggtactggtggtggcacatactatgcagactccgtgaagggccgattcaccatctccagagacaatgccaagaactccttgtatcttcaaatgaacagcctgagagccgaggacatggctgtgtattactgtgcaaga

SEQ ID NO: 6242 - DNA, 867 bp, Homo sapiens
cacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaagaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaa

SEQ ID NO: 6243 - DNA, 645 bp, Homo sapiens
tatggtgtgtgctcggtggggctggagtggctggcttacctcctcgtgccttacagcctgggcgcctcagccacctcactcctgggcctgctgggcctgtggctgccacgccctgtgcccctggtggctggagcaggggtgcacctgctgctcaccttcatcctctttttctgggcccctgtgcctcgggtcctgcaacacagctggatcctctatgtggcagccgccctttgggttgtgggcagctccctgaacaagactggactcagcacactcctgggaatcttgtatgaagacaaggagagacaggacttcatcttcaccatctaccactggtggcaggctgtggccatcttcaccgtgtacctgggctcgagcctgcacatgaaggctaagctggcgttgctgctggtgacgctggtggcggccacggtctcctacctgcggatggagcagaagctgcggcggggcgtggccccgcggcagccccgcatcccgcggccccagcacaaggtgcgcggttaccgctacttggaggaggacaactcggacgagagcgacgcggagggcgatcttggggacggcgaggaggcggaggcggaggctccgcccgcagggcccaggcctggccccgagcccgctgga

SEQ ID NO: 6244 - DNA, 3828 bp, Homo sapiens
atggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttggttactactgaatgcccacagaaaggaagaaacttctctctccctttagacaaagtcgaattcttatcgcagctcataaaatcctttatgaaactggaaaaaggtgttcaagaattgtttgacgaaatacttttatcactcaagataaccagggatacttcaggaattttggagaaatccgatagagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacaagtttccgacacagaaaataacctgaaccaaggacccagcttgatggaagccatctttaaaatattgtaccattgcagtttttctccacaaacatttgcaaacgtttttgtgagctacatggaagaagagcaattatgggactttttatataacatcccagtctcaacgtgcgtggagtacgagctagaggtcatccgatgcttgagactggcactgaccgatgccatcaaggacactgtacagcagatagtatctgtaatgagttctaggagaaactgtgagacaaacctaaacaagcacattgttcctgattgtttgcttgagagcatgccaaaggaatggaattatagtccaaaagaaactaacaggaaagaatcatgcaaaagcttcacaaggcttactgctcaggcagtatctattgtaatcagcaagttacctacggtgattgcatgtttgcctcccccagttaaatacttcttttttctgtctgagagaaaaatgtcaaaaaaatttgttgaattgaagaaagctggcctgcttgtctggaacttgattgtaattatatgtcggatatttgaggacggaaacactgtggaacttttaacaggtgcctctcttgacagatggagtaaagaaaaattgggtttaatttgtatgtgtttgaaaagcatcatgggagaccagacaagtatccataatcaaatgatccaaaaggtcatacagagcattgagcagcagaagcccaactggattgaacgtcaattgttgaaagcaaggaaactgagcactgaatgtgcatttatgacaatagagaaaagcacggccttacaagaaggagatgttgctcttgaactgactgagcagaaaataaacacgatggtcctggatctctgccacaaaccaggtggcagggagtacctgaggcaaatttatcacatcatgcagctcaatgaggaatatttaaaagaacagctgttttctatgaatagttcagaggaaaagccattacccatccgacctttaaagacgaccttgaggagtatagaagatcagccttctgcctttaaccctttccatgtgtataaggcgtttagtgaaaacatgctagatcagtcagccatcacaaaatggaactggaattgggcaaagttgctgccaaattatctgagactggataagatgaccttcagtgtgctgctcaaaaacaggtgggaaatgaagaaggatgaaacactagaagaggaagaaaaagcaatactggagcacttaaaacaaatttgcaccccacagaactcttctgcctcagataacatagaggaacagtaa

SEQ ID NO: 6245 - DNA, 132 bp, Homo sapiens
cgcctgaggtctcgcccgcaggccggtggcgcggggtcagctgctgcctgcggtccaggacagggtcggttccgccgcgcagcgcccaggcccagctcgtccagagtctgcggacagcgcacgtccaggtaa

SEQ ID NO: 6246 - DNA, 3008 bp, Homo sapiens
atgtgagcatggtgacgtggtcacacagcaacagcaataaggagctgaagcaggagaactcagctttggcagagcagcttcaagttgtactgattgacaaggcagggatgcagtgtgacttggaggagctgaaaaagaaactggaactcactgagctcacgcttcaacagttatctagctggtgtgaagcccctgatgctaaccagcagttacagcagcccacagacgaacgggcacagctggaagcacacctggggcaggtgatggagtggctgaagtatctgcaaatggagagagagcagtatgccgagtatctgcatggagagagtgccatgtggtggcagaggatgcgggagatgtcagagcaggtgcacacgttgagggaggagagagtgcacagcatgagtcgagtacaggagctggagacgatcttggctgaactaaggaaccagctgaacccctgcccccggagcctccagcagggccctccgaagtggagcagaagctacaagcagaggctgagcacctgtggaaggagctggagaatctggcaggacagcttcaagcccaagtggaagaaaatgagggcttgagtcacctgaaccaagagcaggaagaggttgctcaggttgttggagcaagaggagaagttgctggagcaagaggagaggttgctggagcaagaggagaggttgctggagcaagaggagaggctactggagctgcaggagagcctgctagagcagaagcggaaggccgcttcctttctcagctgaacccctacccggagcccccagcagggccctccgaggtggaacagcagctacaagcagaggctgaacacctgcggaaggagctggagaatctggcaggacagctttaagcccaagtggaagaaaatgagggcttgagtcgcctgaacgaagagcaggaagaggttgctgagattgttggaacaagacgagaggttgttggagcaagaggagaggttgctggagcaagaggagaggttgctggagctgcaggagaggctgctagagcagaagcggaaggccgcttcctttctcagctgaacccctactcccggagcccccagcagggccctccgaggtggagcagcagctacaagcagaggctgaacacctgcggaaggagctggagaatctgacaggacagctttaagcccatgtgcaagaaaatgagggcttgagtcgcctgaaccaagagcaggaagaggttgctggagcaagaggagaggatgctggagcaagaggagaggctgctggagcttgagtggaaagccgagccttgagaggagcaggtggaggcgctcaggcataccgtgcggaacgaccgtaccaccatcaggcgcgcgctctcccagaaacacgaactgaagaaccagtgctgaggtcttctgcagcagtactatcagcagctgatctctgaggaggaggcactgcacaggcagttatttctgcagatccagctcgtggaccagctgcagcaccagagaaaagagtagcagagatggcctgccaagagttgcaggagacccaggaaagggagttgctgagggcaggtccccgagggggatgagacctggcaacatccatgccttctcattctctttcctgaccccttaggagcgcctggaagcagaaccagtagctacaggcccagagatggactggagagtgaggaggaggaggagccttggtccatgctgagcatcctggaggacctggagagctgggagaccatgatgagcctgactccccatgccccacctttgcttcctccctctctcctccctcccagacacccttatgctcttggtttttctgccttctgatttctttggaccctcaccccttccctgggagccagtggtcagacaccatttcacctgagaccaataggtgcaccctctgaggccccaagggaagggcttctctctactgccctggcccgttcatcctgtgtatccccctacaagaatgggcacctcctgcccgcaggtggcattttaaaacttggctttagccagtgccgaagaggagcaggcacagctacatgggcagctgaaggagcaaagggtgcactgccagcgcctgtcttacccggtggccttggcccagaaggagccagaggcagcagcctcagccccagggactgggggcgattctgtgtggggaaacccaccggaccttgcaggggaccatggggaagctgcagagccgctttatggagctcatgcaggagaatgagcgggtggagaaactggaatgtcgctgcattcagctgtctggacaaacagacaccatcagtgagcgagaggaaagtacgtcacatcataccagagccagaggtcagtgctgaagacgtggaccgggagaatgagtacataagcaggctggctcaggacaaggaggagatgaaggtgaagctgctggagctggtgttgcagcttgtgggcgactgcaacaagtggcatggcagattcctggcagctgcccagaaccctgctgatgagcctgctccatgggacccagccccccaggagattggggctgccaacaagcagggtgatctcccacagtgtggagcctgaacaagaagaggctggggagggttttccccacgacagccccacggcacagcagatcatgcggctgcttcatgagatgcagaacccccaggagcgcccaggcttgggcagcaacccctgcatccccattttttactgagctcaggagagcaagatgaaggtaacaatcatctaaaagccagccactgtcagcaaagcctggagaaatgggaccagagagtctgcccctaccacgtccctgccaccccttcccagttacccctttacccttacagtagcaaaataagacccctatctagtgagggagacaggtgcagatgaggtgaagatcactgtcatctaaaagcaggccaccaaatttaaaaaaaaaaagttatgggaaaaaatttatgggatt

SEQ ID NO: 6247 - DNA, 2355 bp, Homo sapiens
aaagcgcggaaggtcgcggtctcggcttccccggaactttttgctcgcttcgccccgcccccttcccatccccgaaccccgctttccggcccgcggcgaccgccggcaactgttgtggctgccgcattgctcccgccgggctgtagctgagcgcggagcccgtgggggccggtgagtttgagttcctgagatctagttggtgagagacatgatgttctactggttgctgtcgattgttggaagacaaagagccagcccaggatggcagaactggtcctctgcaagaaacagcgcatcagctgccgaggcgcgttccatggccctgcccacccaggcacaggtggtcgtctgtggaggtggaatcacgggcacttctgtggcccatcaccaatccaaaatggggtggaaggatattgtccttttggagcagggcaggctggctgctggctctaccaggttctgtgctggcatcctgagcactgccaggcacttgaccattgagcagaagatggcagactactcaaacaaactctaccatcagttagagcaagaaacagggatccgaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcctgaggatgcagtggtgtcttccgctgacgtggctcttgccctggcaagtgctgcctcccaaaatggtgttcagatctatgaccggacatctgttcttcaagtaatgggcaaaaaaggtcaagttactggagtggagaccgataaaggacagattgaatgccagtattttgtcaactgtgctggccagctattgtggatgctgatggaagaatttatattcggaactggcagggtggcatcctgtctgggggctttgagaagaacccaaaaccaattttcactgagggcaagaaccagctggagattcagaatctacaggggactgggatcactttgagcctctgttgagttcccttctgaggaggatgccagaattagagactctggagatcatgaagttggtgaactgcccagagaccttcgcatcagacatgaggtgcatcatgggcgagtctcctgcagtgtagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccactgggacttccagaccggtaggcagttacgcacctctcctctctacgaccggctggatgcacagggagccaggtggatggagaaacatggatttgagaggccaaagtactttgttccccctgacaagggtaagaagtcacattctcatttttgctcctttttttttttgtcctgggaattaataaaacgtattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacagagtttgagataacagtaagtatttgggaaccaaagtaatagattaggaaactttgcatatttattgaatgccttttgtttttcatcttcaaaactgattcctgactgggtgcagtgggtcatgcctgtattcccagcactttgggaggccaaggggggcgtggatcacctgaagtcaggagttccagaccagcctggccaagatggtaaaaccccgtttctactaaaaatacaaaaattaaggccaggagtggtggctcatgcctgtaatcccagcagtttgggaggccgagacgggtagatcacctgagatcaggagttcaagaccagcctggccaacatggcgaaaccatctctaccaaaaatacaaaaaattaaccaggcatggtggcgggcacttgtaatcccagctactcgggaggcaggagaatcgcatgaactcatgaggtggaggttgcagtgagctgagattgcgccactgcactcagcctgggcaacagagtgagactccatctc

SEQ ID NO: 6248 - DNA, 3975 bp, Homo sapiens
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttc

SEQ ID NO: 6249 - DNA, 294 bp, Homo sapiens
gtctgtgggagcacccaggagaaaaccgtgttcaggctggaggcaatgctggagaggacggccggggtacagagcaaggaggcggccttggaagaggaggcggtgctgaaggtggaagacatcatggctgaggtggaggtggtggttgaggtggaggtggtggttgaggtggagcccgacgtggggtggcagaaggagggccagcgggcacagcctggccctggaccgagcacaccggggccgtcaatggactcgctggaggtccttcacttggagctgggctccgtgaatgcc

SEQ ID NO: 6250 - DNA, 895 bp, Homo sapiens
agagaggaacctggagggaccctgtccctgacaccttctgggttgttagctccagatcaaaagaactcctgatttggaaaaagcttcttgaaaagaagaggggaggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggacca

SEQ ID NO: 6251 - DNA, 438 bp, Homo sapiens
cctggacccccaggaaggcctggcaagcctggtttcccaaagccaggaggccctgggggcccagctattcctggagccccagggagaccttttgttcctggaatccctggctggcctggggctccagcagctcctggctttccaatgccttctggccctcgttccccaggagggccttggggacctggtgggccaattggtcccatttctcccggtccagggattccaggtggtcctggtgggccccggggtcctggtaggccagctggtccaacatctccttttggtccatatggtcctctctctcctggttttcctgggagtcctggcacacctggtttccctacagctgatggtcccggtggtcctggcaaccctggctctccttggagtccaggacttccgtaccctcgaggtccagcagggcctggtggacca

SEQ ID NO: 6252 - DNA, 81 bp, Homo sapiens
gtcccaccactgcactccagcctgggtgacagagcaagattcctgagaccctgtctcaaaaaaaaaacaaaaaaaaaacgc

SEQ ID NO: 6253 - DNA, 3148 bp, Homo sapiens
cagctgcggaggtcagagctggagcacagcgtggatctggaggaggcccttggccgtctggaggctgccgaggagaggagcaccggcctctgtcaggtgaacgcgctcctgcgggagcagctggaacatatgaagaaggccaatgacgcgctgggccgggagctggccgggatgacgggcagcgtgcagcgcctgcagggcgagctggagctgaggcgctgggcccagagacaggagccctccagaacccggtcagggggcctggggcagccccgggacctcctcctcctgtggagacaggccgtggtgctggggacagacctggccgagctgcgtgtagccactgagaggggcctcgctgacctgcaggcagacacggccaggacagcccgccgcctgcacaccgcctgcctgaacctcgactccaacctgcggctgtcggccagcagcacggccagcaccctggggcagcagcttcgggacaaggctggggagatgctgcagctgcagggccgctgggacgcagagaaggtggcgctccaggccagactctcggagcaaaccctgctggtggagaagcttacagagcagaatgagcagaaggcgaagaccatcgctgccctcagaaccgacctgcagaacctggttggtgggcaggacgggggtggctgtgtggcaggggtctgtcacccttgctcaggagtctcccctgccacaggaagcctggtggcccaggaggacgcccggtgcctggagctggcaggtagcagcatcactgaattgggggagccacggcgcccactgaggagcccccaacgtgccacatccccccatcaaggggcgtccccaccacacatctgctccccagccaccctggaccccgcactgcaggccatgcgggcagccatagagaggcggtggcggcgggaacaggagctgtgcctgcagctgaagtcctcccaggcactggtggccagtctccaggagcagctgtccgaaagccggcgggagctgtgggccgcacagaagctccagcaggagcgggctcgggagcaggcacgggaacgagaggctcttcggggccagctggaggcccagaggctcgaggtgcagcagtgccgggcatcctgcaagctcctggggagggagaaggctgctctggagatggtggtggaggagctgaaagggaaggcagatgctgcagatgcggagaagcaggggctggaggccgaggctgcagagctgcagagaagcctcctgctgcaggcagagcggagggaggagctggctctgcggagggagcggagctgcagggcactggagaccagtcaaggccgcctgcagcagctggaggagaaggtctccgggctcagagaggagctggcatcggtccgggaggcactgagcacagcacagctgcagcgggatgtcgtggagagtgagagggagggactgcgcagcgccctggcgcgggccgagtgcagcaatgcggacctggagcttcttgtgaggcggctgaagtcggagggagtggagcaaagggactccctggccgcaatggccgccttgatggaggggttggctcaggacaaaagtgccctgaaccacctggctctccagctggagcaggagcgggaccagctgcgggaacagcggaagactctggagcaggaacgggcccgggccggggagcagctggcacaggcggagcagcagctggcgctggagcgggcagagcgcaggggcctgcagcaggcctgcggacgcctggagcagcggcaggagcagctggaggggcaggcagccctgctggggcgagagaaggcccagctccaggagcaggtgggccaggtcacatgccagaaacaggccctggaggagcagctggctcagagcctgcaggaccaggaggcccagatgggcactctgcagcaagccctgcaaggaaaggatgctctgtctgaggagcgggcccagctgctggccaagcaggaggccttggagaggcagggccggctcgcagctgaagaggcagctgatctcagggtggagagggactccctggagagcagcctccttgaggcccaacagctggccacaaagctgcaggagcagctggaggaggaagcccggagcgcaggactcgcgcggcaggccttgcaagtggaaatggagcagctacaaagtgactgggaggtccaggaaatgaagctgcggcaggacacggtgcggctccagcgacaggtggcacagcaggagcgggaggcacagcgggccctggagagccaggcgttggcccaccgagaggccctggcacagctccaaagggagaaggagaccctgagcctgaccctggcagaggagaaggaggtagccagatgccagctggagcaggagaaggagctggtgacaaaaagtgcagctgagagggaggctctgaagggggaaattcagagcctgaagcaggagcgggacgagagccttctccaactggagcacaagatgcaacaggccctgtccctgaaagaaacagagcggagccttctgagtgaggagctctccagggccaggaggacgctagagcgggtacagcaggaggcacagagccagcaggagcaagcgcaggccaccatcagtgccacgactgaggagctgaaggccctccaggcccagtttgaggatgccatcacagcccatcagagggagaccacggccctacgcgagagcctccaggacctagcggctgagcggggcgatgtggagagagaggctgagaggctgcgggcacagctgaccgtggcccaggagggactggccgcactgcgccaggagctgcagggcgtcgaggagagccgggaggggctgcacagggaggcccaggaggcccgccgggcgctgagtgacgaggcccgcgagaaggacgtactgttgcttttcaacagcgagctgcgggccaccatctgcagggccgaacaggagaaggccagttttaagcggtccaaggaggagaaggagcagaagctgctcatcctggaggaggcccaggcggcgttgcagcaggaggccagtgcactgcgggcccacctgtgggagctggagcaggcagggggggacgcccgtcaggagctccgggaactccacagacagg

SEQ ID NO: 6254 - DNA, 1687 bp, Homo sapiens
tggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagtgcctgtaagacaggaattcagggcaaaaatgtgtgctatatggctgggcgtggtggcccatgcttgtaatcgcagcgctttgggaggctgaagcaggaggattgtttgagctcaggagttcatgaccagcctgggcaacctagcaagacctcatctctacttaaaaaaaaaaaaaaaaa

SEQ ID NO: 6255 - DNA, 4217 bp, Homo sapiens
gccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatct

SEQ ID NO: 6256 - DNA, 392 bp, Homo sapiens
ccctcgtgtgtgcctgtgttaaaaggagcccacgcagccgacagcagcaggagcaaatggcctgctctgatggggacaggcaggaagtccttcggggcatttctgtttcatcacagcttttcctggggctggaagctgatcagtatctcctttggggacctgaaccctttccccgtacgccagatccggaaccgacgtgcctaccacttggagaaagtccggctggagctgaccgagctggaggccatccgtgaggacttcctgcatgagcgggacaccagccctgacaagggtgagctggtcagtgacgaggaggaggatacctgagtgggctccgggacgctgctcttcctgccttcacaaccaaagtgtgcccaaagggtgaaagtgca

SEQ ID NO: 6257 - DNA, 5224 bp, Homo sapiens
cggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcggc

SEQ ID NO: 6258 - DNA, 1151 bp, Homo sapiens
gagggctctatggatagcttatatgagccaatcccagagcaacaagctaaccaagaaaacatgtctagtagaactgattctcctatcccaccctttggagagagtgaacaaacaccaaacaatctcttcgtgggagtttctaatttagagaatgcaaaaccaaaaaagagaaagttattccggagatttatgtctgaaaataaaatatttgaaggaaaaactgtgaatgacaaaatctggcaggaacacagcaagcataagaatgattcccacatcagaaggccctgtcagctaaaagatctaaatgaaaatgattttctaagtaacaacatacatacctatcaaggaaaaactctacaaggaacttcctatcaggtgacctctgaatgttggagtccatttcactatcaaagacatgttgagaccactgttgatgaactggctcaagaatttatgtaaagtaacaaaagaagatacttatgtagtcaaatgtccccaaggatatttgaggaacaatgaattcctgtgatccaatccttcaatttaaagatgaagggctgaagtgcagagaggagaagtggctcactcaagttcacatggccagtcacaaagcagattttcaaagcagaacaatcattagtcggcacacaagggcaggttcttactctaggttttcttaacatttcttgtgtatatgaaataaatattagataaaaatgtttttttactgtgtaattttccattcatagctcctcttcttgctaagaatccaatagatacttaataaaaattaattaatttgcatactggctcttaaatttcctattgttcataatttttggtcagctaggaggtgtacccagaaacagaaatgttcttatgagtagttctagaaacttcttcaaaatttcagagcagaggatattacgcaggaagtaagaaagatgtggcttctgtggccttttctcttaaatcaacacaacccccatttgcaatgctggtttgtgtaatcctggcaactcccagctagcttggcagtgtgtccacattcaaagactgacccaaagctataggtcagtgagcaaaaagcagtcttggcttcccctgcagaagtggagaaatggcagtgacattgcgacttcattatacta

SEQ ID NO: 6259 - DNA, 1714 bp, Homo sapiens
cccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattggttaaaagctcaggctctgtttaagtcgagagaactggttgctgaaaaacagcttactaaaccccaagaactcaaactggatatgaatggcagtgactctggaccaagtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccgcccaggaatctccacaaagatctgcttcctttcaaatcatttcttcatattgttctcctag

SEQ ID NO: 6260 - DNA, 833 bp, Homo sapiens
ctccacaaagagaaaatggcggaatgggccttcgcctcccttttataacggctgtactcaaccgctgtatcttggaagctttgttttgattgggtgagaaggaacttttttcgacaactcttattggataatagtctcctgctctgactggataatcttaactaatcagagttggagacttatccaatctgtgttgtagtacagagtctgctctcatcctatcagaaagaggcttccagggtatgtcatttgaatacagacattataaaagggaggcaaagatctgcacctgccgtggaggttgggctcatgtgctcctctgcattggagttagccaaggagcgtgtgcagaacacttgcctcataggccagccgtagagaaggatgtcccaggtgcaggcgaagttttgttcatgtgttcctggaggatttttcccgtggcaagcgcttctccatcctccagcatctcaggcctggctggccactcagtattccttgtccctggcctcgcagcccacccgggaagccacagtgaccagccaccaggtgtgccatcacggaggaagtccaggttggagaggtggtctccttctgtgagcaggtccacctctccccccactgaggcccctttctgcctgtgacagccccacctcaagggccatggcacagccatcagctccagctgccagcatgctactgccatgccccgagtgtccatctgggccccggttcatgacctgttgtctttctgtatctactttctgcagcccctcactgaggaggcctcctgggtttgtccagtgcctgctattaaagctttgctccaagttcaa

SEQ ID NO: 6261 - DNA, 1952 bp, Homo sapiens
aagcgcagcgcgcgcggaccccgggggcagtttcctagcaaccggcggagcggctacgtcacggtggcaggttctaagcgctgctgggcaccgtaaggccgccgtgtgtaccttccagtagctacgggctggtggaagcgctgctcacagtcagtgtcgaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttg

SEQ ID NO: 6262 - DNA, 627 bp, Homo sapiens
atcactccgacccccccacctccgcccagatcccgagaaaaagaaagccctagggtggcagccagggtagtggtcccagtgcgatccagagagagggtccttacctcgatggggctgaccggcgtggaaggcaggggctgcaggtactcggggtgcaaaatgtggccagttcgtgccgtcagcatcttcagcaccttgattggcaggcggttggcctggcgcagggggtcagaggggggcacggcgtgcacaaaaggcttggtgctgccggccggggacgagcctgggccggggccggagctatttccagagagcgcgctggtccaggcagggtctgcaccgccgcctccgcctccgccgccgccgccgccgctgtgcttactgcttcttagggcagaaagcgagggcgctgtgctcatgacccacccgcgcgcatgggagcagcgggggggagggctccgggaggcgcggggcgggctcggggctgcgcgctcgccccgggagcaggagcagcgggaggaggaggagctggcgcggcggccacgggcgcccagcgcgccttctcggcgcctggagccagacgcgagtaatcctgggtggcccgcagcggagccgtggccgggctag

SEQ ID NO: 6263 - DNA, 972 bp, Homo sapiens
ttaatactgtgtctctggtggctctagtgatgcaatcattctcgatggggccactgactctgatgtcacaatgacttggctggaggtgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaag

SEQ ID NO: 6264 - DNA, 236 bp, Homo sapiens
atgcgtcctccctctccagtcccgcgtcggtcgccgcagtcacggagcgcacgtcgggaaacctctcagcctcatctgtaaaatgtgatcataaataccgggtacctggaagtgctcgagacagatctcactatgttgaccgggctggtctcaaactcctggcctcaagcagtcctcctgcagcaacttcacagcaacactggaatgacagaagaactccactgaacattcattga

SEQ ID NO: 6265 - DNA, 2441 bp, Homo sapiens
aggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgt

SEQ ID NO: 6266 - DNA, 438 bp, Homo sapiens; identical to SEQ ID NO: 6224

SEQ ID NO: 6267 - DNA, 2290 bp, Homo sapiens
acacagcgacgtagaggtgactggaggtatatacttgtcctcacctggatcatgctgatgtggccccaaccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagcgggaggagaagatacaggagcaggaggagaagatacgggagcaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggaggagatgatgcaggaacaggaagagaagatgggggagcaggaggagaagatgtgggagcaggaagaggagatgcaagaacaggaggagaagatgcggaggcaggaggagaagataagggagcaggagaagaagatacgggagcaggaggagaagatacgagagcaggaggagatgatgcaggaacaggaagagaagatgggggagcaggaggggaagatgtgtgagcaggaagcgaagatgcaagaacaggaggagaagatgcggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgcgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttggcattcatagtaaacttttatctgcctccag

SEQ ID NO: 6268 - DNA, 1090 bp, Homo sapiens
ggcattgtggggggccacaatgcccccccggggaagtggccgtggcaggtcagcctgagggtctacagctaccactgggcctcctgggcgcacatctgtgggggctccctcatccacccccagtgggtgctgactgctgcccactgcattttctggaaggacaccgacccgtccatctaccggatccacgctggggacgtgtatctctacgggggccgggggctgctgaacgtcagccggatcatcgtccaccccaactatgtcactgcggggctgggtgcggatgtggccctgctccagctggagccccatgatctgagcaatgtcaggacggtcaagctctccccggtctcgctggagctcaccccgaaggaccagtgctgggtgactggctggggagcgatcaggatgaaagagtcgctgccgccgccctaccgcctgcagcaggcgagtgtgcaggtgctggagaacgccgtctgtgagcagccctaccgcaacgcctcagggcacactggcgaccggcagctcatcctggatgacatgctgtgtgccggcagcgagggccgagactcctgctacggtgactccggcggccctctggtctgcaggctgcgggggtcctggcgcctggtgggggtggtcagctggggctacggctgtaccctgcgggactttcccggcgtctacacccacgtccagatctacgtgctctggatcctgcagcaagtcggggagttgccctgagcaggctgggctgggctcccacctgggtcggctgaggagggaccaggaccttcctcctcccagcgatctccgcttcggcctccgctgcaggccaccgtcttgagcccggcttctctggctcctcagcgcccaggacctccctgatgccggggtggggaaggggccggggaagggagggtgggggcctcgctgcgtctctgtctgattaaagagcaagagcagagtgtgtggcgtctctgtgggatggatttgcattccaagctgcagccaggtgcggtttgctcagccacctcctgttggaggcctccacattttggctatggtaataaagatgctgagaacattc

SEQ ID NO: 6269 - DNA, 3541 bp, Homo sapiens
tattgaggcactggcccagggaactgagccttgggcctgtcctaaagctccataggtgactgcactgcagcccacatggagagctgcagctctaacacagggattttgagaggcctcagtgccatttaagtggcacttccaggacacccatcctgagctcccacaaagggcgccaccttcccaagaacgtctaattgtcattggaacagccagtgtcaggcagcttctgctcaggctgatgtggcgtctgacccttggtgggttgccagacattccttcctgtttctgccatgggaagttggcactgggaatggtatggagcccccacttctaccctgagccttgggtgtctgctgcttccaggtgaaaaatggacatttctgatactgcccagccactacggcaccacaacccatgctcatagtctccagggatgtgtagaacggcaatggcaggacagcaaacaactggcgatttccccaggtcccacgctcttgcggagtgagtatgttgggtccctgtccccagtgtgttccagccttacccaggtgcacagagtaccctggggccagcacagggcttgtccagtgatgctcctggtgttcacaaaatggctccagagatacctgcattttgaaaagcctgccgagccagcaagtgtagggcaggacccggatttctttggcaaatctgaaggtgagagggccacttgcctgctgagtagaagctgcctttacctggccagtgtatgcaacttgagagaaaatgacagctgcatggggcgctctggtgggactgggaagtctgatcttccggggagctgtagatagtgaatttcaagttgacagctaccttctcagggatttatatataaatatagttagaggaaaagctaaaatctattttactagtttttagtgtttgtgtaaagtaagcttaaactggacagaataaacatttctcagacaatgttgatgctactgattacaagttagatggctggagcttgccccttggtggagaatttcttggtgattggagactggggactctggcagcagaagtggctttatggtgggtgtgaagttgcttctgcccctctgagtggcctctcatggatgtgaatgcgtgtattgacaccagtgaaatccacctccgtgtgcgtggaggtggctgatgagaacacaagtgagccagtcctggttcttccctccagaaccggtcactcccagtctgacgttggagcatgtgaactaagagtgacatttttttctacttgcttctgtgaataaagtgttctacagtcagccagcactaaacaccagaaaggaggagggaacagcgtggagcaattcatctggaattacctcggtgtgcagaggctgtcccttggctccacttgggataaacattgtgaaacatcgtgggcctctttcttctcaagctcctcctgacagcctcctggcaacactagaggcctcaagactatggagatcagaattgcaatggctttgtcatctcagcattgaccactcctgagacccaaggttcctcctgggagcaggagacaaggagtttgtgatgttggatggaaaataggatatatgaatgcagaagggctgtgctggacccctcttttcgcttctctccctgctgtcagcagtgtctctggcatggaggcgaatctgttgtgggtgaaacagaagcccctggggtaggaccagaccccaggcctgaaaaggatgcaaagcctgctgtttcaggctgtcaggaagaatcgtgggtaccgagtgattatgatgaaatgcaacccagagaggaaatgaatgggccctcactaagaagtgggtctgacatgtctctggcagcccaccggcaagagcacgacatgccctgcagccccaccatccacactacatgatgtgggagggctgtctgttcattcttacactggggacccaagcctgctctgaggagtgagtcacagccctgacgtgcgccttgcattactgtttcctgagatgtgcccggagactcaagcttgctcatttctgtcctgacacagctcactgttccttaggtggtcatagtcctcccgtgctgtgtcagctcctacatagcattagtctttcacgtgataaagtgcaagcacttttccattttacagtatttggggaaattctaacacactccccagggatttgtgcatgtccttctgcctccccggtgggtcattctgtggattccgcacctggcagtcggtcttcccccttggaagcccctaggatccctgtttctacgggcctggtccttggtttctaccccagtcccttttggccggcacctgcctggaactgcctggagcgccatggtatggggaaggacaggtggaaccctgaccacaacagatccttctaaaacaacagtcacattgatgatgatgagtgcagtggggtgaatgtcgtcacagcatgcatgctgggagctgccaagggcttacaacaaaagcagttcttcctaaggcaccctttgcatcttcccatccacgcctctcagtgcatttggaacttgcttatgcattggaataacttgagtcagctgctcgtttctgtgcctctgcactcacaggttccttcattaacattttaaataagtggttaaaaactcctctggaggttgtttttgaaagaaacagggaaaagaaaaacacacactacctgaattgatttgagtaattttccagtgactcagttgaaactcagtgttgcatacataatttcctcatgctgagccagcctgaaataagacttgataagaggcacagccctaagtagcaggcagtgccactgtggacagtgtacactatggtgtgagtgtgtgcacaggcgagcctaagtgtgtgtactcatacacacagataaaccgaaaggacactgggctttgtgctggcaaaggctgtgatgctgctgtggctttctatgggccctggggagtgtcagatgggaagtgctttgatggcatgttgttcagtgtatttaatggggtctcccatggcccgaggacccactgtgagcactccacccactgtggcgcagaacacggctggagtcatcatagcccaggtctttattgaaagggagtgttgacccagaagcctcatatagaaaccatttggcaaggtctggaccatctctctgcaactgacctgccttggccgcacagagggacccaaacccaaaaggcccagacccaagggagactgaatcacatttaccattacaccagctttcatttatttgtttccatatgatcatagggactgtattactaagtatgcttataaatgctatttacagactgttcccttttataaggtgaaagattaataaagaacaaaaaattgcctgtagaaaaccatgcctgaggccaggagcagtggctcatgcctgtaatcccagcactttgggagaccaagacaagcagatcacccaaggtcaggagttcaagaccagcctggccaacttggagaaaccccagctct

SEQ ID NO: 6270 - DNA, 81 bp, Homo sapiens
ttccctagttttgacatttcattctttttgttcatttatcttttcaatagcagtcactcccctgacagggtctcactctgt

SEQ ID NO: 6271 - DNA, 1363 bp, Homo sapiens
acccctggaggctgacaaggctcgctgacccagaccctcaccgatgaagcctccttctcttttcctccctctcactgccctagagcccaggagccaggcagggcatgggagtggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacg

SEQ ID NO: 6272 - DNA, 390 bp, Homo sapiens
tggaagccccagcacagcttcttcttcctcctgctactctggctcccagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagacca

SEQ ID NO: 6273 - DNA, 696 bp, Homo sapiens
atggcaaagtgggtcccggctctgctgctccgccgcgtcccactcttctcgctccgctttcgccccgcatcttccaccttccttccagtccttgcggcgaccgagcccgcagtgtcagtccccagcggggacctgagtatgccggtgaagacgagagcggaaggcgaggacgacggcttcggggaagcgggtgacccgaggagactgctggagcgaccttggcgtttccgggggtgccttcccgggaaggggaatcgggatgttggcttcgaagggaccgaagggcccacctcgacccgccccgagtgggtttggagttgtaggtgctgtctcggatgcagggcgagcacccgcgagcgggtaaccagtcccgtgagagctgcaggtccccagccccgttttacagatagggaaactgaggcagctgctgggacactcgcccatatgggttttgctccacccacttccttcagccactttacagaccaggagttgagggactgctcgagcttagagtgtttaggggtggttgagggtgacccccatgttctgtgctctactctatccctatccaggccttctcccagcgccactctcacgctcctgcttgctagctcctgcttgctagctcctgctcctcccagcttcatcctcctcctgtttacattaattgctcctgatcttccacactcttga

SEQ ID NO: 6274 - DNA, 1248 bp, Homo sapiens
ctgataaggtctgttaggttagatataattgctattttattttaaatcacagcaaagttatttgtgttcacccttgggtttatttagaaaatacaaggttacaaagggcttccaaagatcattattagcagtaagaagattaccgaggaaaggaaaagtggtaaggaagtgggaagaaaaccgaagactgatgactgaataagatcttacatatttgcatagctcagaaatttgaatactatatccaggagtctatttttttttcaacttgtaaaaaatggtagtaaaatacaaaaaacataaaatgttctatcttaaccatttttaggagcacagttcagtgttattaaatatattcacaatgttgtgcaaccattaccaccatccatctccataactctgttcatcttataaaactgaaactatggccgttttaagtccccattgcccttcttcccagtaaccactattctattttgtctccatgattttggttactctatatacttcatgtcagtggaattacacagtatttatatttttgtggctgggttatttcacttagcataagtccttaggattcatgtaatgtgtagtatatatcagaatttccttcctttttaaggctaaataataatccagtgaatggaaatagcacattatgctaaagtattcactgctgatggacatttaggttgctacattttagctactatgaattatcattcagccaagcactgtggctcatgcttgcagtcccagctatgcaagaggttaaagcaggaagatcgcttgagtccaggatttcaaggccagcttgggcaacacagtgagacctcatctcttaaaactgtaataggcccacttgctccctcctgccatctggctgacatgaagaactggaggtggcagcagtggtagcctgcatctgaggctcatgggctgcaagcccctgctcgtgcaccatggatgattttgccaaagaaagtttcactgtagtggattatgtcttgttagaaaattgccctaatatgggtgactatgtcgttgctcctcaatttatgaccgacaattatgttcgtgtgactcagcttaactgggatggggtgggtacgcaataaaaagattacatctaagtgagagaaatttagcaattcttgtggttctgagataagtttgaagaaatcacaacatcttgagttgatagaagatattgtggatttggcaaagaaagttgctgtaagtggt

SEQ ID NO: 6275 - DNA, 1543 bp, Homo sapiens
gaaaagagggccgtgtgcagtgtcggaaggaaaagtgggcagtgcgcactgtgggagggaaaagagggccatgtgcactgtcggagggaatgtgagtgaggatgcctgctatggagagcccctggagtttcctgaaaacactaaaaatagagccaccttgggatccagcagtcccactgctgggcatacgccccaaagaaaggaaatccgtatatcgaagatgtatctgcacatccctattcattgcagcactacttacaatggccgagatttggaatcaacctcagtgcccatcaacagacgaacggataagaaaaatgtggtgcgtaggcacagtggatactgttcagccagagaagaaaggaatcctgtcatttcagccgcatggatgagcctggaggaattggggaaatcagccaggtgcaggaagacaaacaccccaggatctcacacatctgtgggagctaaaaaagccgaactcaaggcggtggtgatggactgctggttgccagagtctggggagggggtaagagttagagccagacgggagaataagctctagtgttcctggcactccacgcaactgtggttgacaacaatttattgtatgttttcagagagctggaagagaggctttggaatgttcccagcacaaagaactgacaaaggtttgaggtgacaggcacgtgaaccgccctgatctgactatcccacatcatacacgggcgtcgaaacaccaccctgtattccagaaacaggtgcaattattgtgtgccaattaaaaaaaggagagcgagaagagagagagggcgagctgggccgtggaagtggaatcagactcggagctgatgaggccagcgtttcctcctgtctcctttgatgctgaggcctgacgtcactcccgtgccattcccagccttccttcagagtccctgcgagccctcaggagctgcgtggtggggttgacgatggccacatcccgggcacctctggctgctgcaggcctcccaagaccgcttcacacttctgtgccgaccaggccaccagccagcgttgcctcttgcagaccactcggccgctagtggggtgcgcacagcagcaggctttctgtacccagagaggcggcagcaggagagccacagagagcacgggagcttctccacctcgcctggcccctcacgtgcggagcacgtcccctccagactgaagggcgcacatcttgggctgcaggacagacgcccccagggctgagctgtgtggtgcaggccaaacgctcccggctcccctgagcactggccttggaggtgaccacagagaaatgacctgatggccagaaaacccaccgtgatatttaccaactgcactcaatttaaaaaagcaaatccctaaaccatcacgtgtgcctaataaatggagcgacataaatggctaagaccagtttctaaacaaatgcctttacaaaatgaaacccagccattgtttaggaacaaaggtataatcagatcctcattttctattccaataaagtctttgaattaatgtc

SEQ ID NO: 6276 - DNA, 486 bp, Homo sapiens
cataaaaatacatatatacgtacgtatatacatatatgtgtgtatatacgtacgtatatacatatatgtgtgtatgcgtacgtatatacatatatgtgtgtatgcgtacgtatatacatatatgtgtgtatgcgtacgtatatacatatatgtgtgtatgcgtacgtatataaatatatgtgtgtatgcgtacgtatatacatacatacatgcatgtacatatatacgtatatatgtatgtacataatgtgtatatatgtacgtacatacatatatgtgtatatatgtacgtgcatacatatatgtgtatatatgtacgtacatatatacgggtatatatgtacgtacatacatagatatgggtatatatgtacgtacatacatatatatgtatatacatgtaagtatatacatatatatgggtatacatgcatgtatatacatatatatgggtatacatacatgtatatgtatgtatgtattttt

SEQ ID NO: 6277 - DNA, 342 bp, Homo sapiens
gtcttgtgtctttttttttttttttttttgagacggagtctcgctctgttgcccaggctggagtgcagtggcgcaatctgggctcactgcaagctctgcctcccgggttcacgccattctcctgcctcaccctcccgagtagctgggactacaggcacatgccaccacgcccagctaatttttgtatttttagtagagacggggtttcatcatattggtcaggctggtcttgaactcctgacctcaggtgatccacctgccttggcctcccaaagtgctgggattacaggcatgagccaccgtgcccagccgatgtgggacctttcagggttgattagattg

SEQ ID NO: 6278 - DNA, 273 bp, Homo sapiens
gggggcgccaaggaagagcccaagaggagatcagcacggttgtcagctaaacctcctgcaaaagtggaagcaaagccgaaaaaggcagcagcgaaggataaatcttcagacaaaaaagtgcaaacaaaagggaaaaggggagcaaagggaaaacagactgaagtggctaaccaagaaactaaagaagatttacctgcagaaaatggggaaacgaaaactgaggagagtccagcctctgatgaagcaggagagaaagaagccaagtctgattaa

SEQ ID NO: 6279 - DNA, 1139 bp, Homo sapiens
ccgccgagcgcttcgtcccggccctaagtctcggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctc

SEQ ID NO: 6280 - DNA, 1238 bp, Homo sapiens
ttcctcctcagccccgggccggagcggggtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagattgacttgatgcaaaacatcacaaaggctccatgttacacagtatgcgatttttgagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgcacatgatgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggatacagttgatatattagttggatggcatagagatcatactcagaaaccttcgctcacgcagcaggtatctgggtggttgcagagtttggagccattttgggtagctgatcttgcatttcctacgactcttcttg

SEQ ID NO: 6281 - DNA, 318 bp, Homo sapiens
ctggagtgcagtggcagaatctcggctcactgcaacctccaccttctgggttcaagtgattctcccacctcggcctcccaagtagttgagattacaggcacttaccaccatgttagcctaaattttgtatttttagtacagatggggtttaaccatgttgtccaggctggtctcgaactcctgacctcaggcaatccgccctcctcagcctcccaaagtgctgggattacaggtgtgagtcaccacgcctggcccttccccttcaactttgctgagagacagggtctcaccatgttgcccaggctggtctcaaactcc

SEQ ID NO: 6282 - DNA, 1885 bp, Homo sapiens
gcaaaatgcaaaaaaaaaaaaaaacctgctttcttcaaacaaaaaaaaattgcagggggaaaaatagacagaatgaggaagcagtatatgaaataatcaaattaaaaactgagggcagaggtgtggtaacacaggtctataatcctggggctttgggaggctgaggcaggaggatttcttgagcccaggagttgaaggctgaagtaagccacaatcatgccactgcactccagcctggatgacccagtcagactcttgtctctgcagaatataataataattttcatttaaaaactaactgggagcttttaaaaaaattgcaaatgggaggcaggactagcttgtggctccactcagagcagcatatggagacttgtaaacttttgctccaagaatgaccacagaaacataccaggaaagctcagagaatctacagaccctttgaaggaagcagcttgctgctgcagactccataagacagttgaaaagctgtaagtgcccaaagtgcaaaaggggaaacatccacccccctcccaatacacatcctcactggggtacctgaaggtccagatcatgggagaaggatttaacctttcctggagctgagacaaatataagagatgagcgaaatataggaatagaggaagcagaggaaagagccccgtgggcactcttggtccccagggaagccattgttgactttgtctcagaggggtccatggggagagatgccactagaattggggaaagactacagggagaaggaaacttccagctgaactttgtaacaatttcaagtaaactcaaagtttcctggacagaatctgggaaaggggtgacccaggagagaagatacagcacagaaactggggcaggtggggaggcacaaatcctgaaagctgcttgctttctcagtggagaggcttggagcctgagacaagttttcagccctgctcaccggctgcctggaaataaactcagtgctattggggtgcacagtgaaagtgagaccagcctttcaggctgcgttggagctggatgaggcctgtcactgcggcctttcccacttccctggccacctgtatgatgcagaagaggcagccataatccccctgagaacacaactccactgggctgagaaccacaaccccataccccacaggggctgaagcaggccctgcccaagaagagtctgagctaaaacatgcctaaccctgccctcacctgaaggtctctctctacctgccctggtagccaaagacaaagaacatagtctcttgggaactctatgccccaaaccacagcctgagacacccaaatacttatccaagcaaccctagggcaagcttgtattctccctatactactgcagctgatgctctcttgaaagcaccacttcctggctggaggccaaccaacagaaaacgagtatgctaaataaaaatacaaccaaggaccctcacagagtccacttcactcccctgctacctgcaccagagcaggtgctggtatccactgctgagagtcctgaaaatggatcacatcacaggaaatggatcatatcacaggactctttgcagacactccccagtaccagcccagagcccagtatctccactaggtggctagactgagaagagcagtaacaatcactgcagtccagctctcaggaagccctatccctaggggaagagggagagcaccacatcaaaggagcaccctatgggacacaagaatgtgaacagcagcccttaagtcaaatatcttccccctgacataatctacccaaatgagaaggaaccagaaaaaacagttctggtaatatgacaaaacaagattctttaacacccccaaaaaaatcacattagcttaccagcaatggatc

SEQ ID NO: 6283 - DNA, 495 bp, Homo sapiens
cgctggccgcaggggccgcaccacgccccagaccctggagtttccgggtgcgcagacccttgccatcagcagaggctgccgctgcgcgtcccctaggcgcggaagaggcggctggtggtccctgacggcaagggttttatacattacgaataaagctggcacgtttccatttctcctgggcaaatatttagaagaaaagttgctgggtaattgggtggagacaaggtttcgccacattgactgggctggtctggaactcctgagctcaagcaaccggccctccttgacctcccaaagtgctaggattacaggtgtgaaccaccgtgcccggccctactttctatcgaagtagaataggtagatcacattattattaacagtatatgggaagagggaggtcctcccatgttacattgttctcccttcaccttctgggtcatgttgcaccactgtttcccttctagtcatatcccagggggccttgtcccatttata

SEQ ID NO: 6284 - DNA, 812 bp, Homo sapiens
tggccgctgggaagttgggagagccaggctggggctccggcaggcccagggaaagttccctttctaggctctttattaaaaaatttaaaaggaggagttgaggcgccttgaattttccttcgtgagtttggagaccagccgatttttcatgaagctagcaaagactgcggtcctggatcctgcaacatatacctcattttctccaggcctctccacttgctcgagctctcagccaccaggagacagacggaaggggcttctgggctgtgttgggagcgggcactgtcccctacccactcctgcacagtttcccaaagtccagcgacctccgaccctccttgggggaaaaaataccagtacccagacaactctgcatcctgttatatgactgggcttgcttcaggaatatcttacaaagaagaagaagaagaaggaagaggaggaacggcttggagtcatgtttacatctagttctactgatccgttcacatctggagagtttatttataactccctctataactctctgtttggaggcactggtggctctactgacagactgatgtctaggaaatattgctctatgtctaaccgtacctaaatgtgctgtggttgtatttacagatttacgtttgagggaaatataattatttccattgtatttgtgcatatacagtagttataggagcagatttatatatgggaaaatatacgactctcttacagccatccggctttatgtacatttgatatcctaacagatttatatctctgaacagctatatagataaaaacgtatatcgttagaatta

SEQ ID NO: 6285 - DNA, 780 bp, Homo sapiens
gtctgtgggagcacccaggagaaaaccgtgttcaggctggaggcaatgctggagaggacggccggggtacagagcaaggaggcggccttggaagaggaggcggtgctgaaggtggaagacatcatggctgaggtggaggtggtggttgaggtggagcccgacgtggggtggcagaaggagggccagcgggcacagcctggccctggaccgagcacaccggggccgtcaatggactcgctggaggtccttcacttggagctgggctccgtgaatgccccaggccacagagcaacaaacaaacaaaaaaaaaaaaaagaaagaaaagaaaaccctaatctctggaaacctgggtccacactccaaaaaccaccacagttgtggcgttgcctcctcgccagacagaacgagatgtcggcgtgggtcggaaagcatgcggaagtcctgctttgctacgtgatggatttgcaggtggaggaactcagccatcccggttaccggtggcagatgatttcctttcatcccaacctttatttccacagtgaaatcatcatgaaggagcactgtgttggcatcctcggctacagggtgtctcattccactgcagtccagcggttctgggatcacgaaggtcaagcctccagctgcaggcagtacacctcctacctgagctcattcagctgtttggctgaacatgactgcccgggttttggcaggattgctgagtccaccagatcatcagccagggcctgtggctctatattctgcagcactacccaaggg

SEQ ID NO: 6286 - DNA, 285 bp, Homo sapiens
agtctgccggaggccttggtacagcctggggggtcccttagactctcctgtgcagcctctggattcacttgcagtaacgcctggatgagctgggtccgccaggctccagggaaggggctggagtgggttggccgtattaaaagcaaagctaatggtgggacaacagactacgctgcacctgtgaaaggcagattcaccatctcaagagttgattcaaaaaacacgctgtatctgcaaatgaacagcctgaaaaccgaggacacggccgtgtattactgtaccaca

SEQ ID NO: 6287 - DNA, 653 bp, Homo sapiens
cccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcc

SEQ ID NO: 6288 - DNA, 120 bp, Homo sapiens
cagaaaggaggagtggaagggaaatggcaggcagatgcagtcctgagctggtgcccccttgccttcgcagtcgtgcctagtaaacagctctctgaactttggtacatttgttctgactga

SEQ ID NO: 6289 - DNA, 4294 bp, Homo sapiens
tcttccctatccctagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatg

SEQ ID NO: 6290 - DNA, 537 bp, Homo sapiens
gagctttctagccagaaaaccggagggaatcttgacaggcacacagcatccaaaccaacagcacttctgcagccggggcccggctggcagaggggtgctgcctgctgcctgcaaatcctgccagagtcaagggtttgctttcctactggtcttcctttggctagaaaagtgacaaaactgagctgggtggggtataagttacaggggcgagagcttcagtggcctgtttatcgggaggagttggagctggagcggctcctgtggcggcggcggcccggggaccgtgatctccggcgcacgggggacctgcgcctcggggagcgggaccttctcctcatccgtgggggagacctgcgccacataggcggtggtggcaacattctcctgggagggctgaatctcctggggggtggcctaggccagggggccagcacggcggtggcagtgatctcctggccatcaatttgtcctcctccatccatgtgcttcagcgccttctcggcttcatctggattctcaaactctacgtacgcatag

SEQ ID NO: 6291 - DNA, 2308 bp, Homo sapiens
acacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcaaaccatacgaatccttacatgtcagaaaactgagcttcagatggcactttactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagcgggaggagaagatacaggagcaggaggagaagatacgggagcaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggaggagatgatgcaggaacaggaagagaagatgggggagcaggaggagaagatgtgggagcaggaagaggagatgcaagaacaggaggagaagatgcggaggcaggaggagaagataagggagcaggagaagaagatacgggagcaggaggagaagatacgagagcaggaggagatgatgcaggaacaggaagagaagatgggggagcaggaggggaagatgtgtgagcaggaagcgaagatgcaagaacaggaggagaagatgcggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgcgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttggcattcatagtaaacttttatctgcctccag

SEQ ID NO: 6292 - DNA, 399 bp, Homo sapiens
ttcactcagacatataggaggtccaggcagcatgaacagctccctggtcagagacacatggatttgctcactggttactcaaagctgattcaaagccgattaaagctgctgcttcatctggggtcccaacctccagtgggaaaaacattcttcttttcctgctggtgtcacccactgttccacggatccaaaacaacacccaatgtttggtacaaatttagtgaaacagctctttccattcttaactcatgccaagcatctcagcttggggtcaggaaaatgccaggggacatgagctcttctcctagagttagagaattctctgccttagttgcaataaaggaaaagatacacattcttcctacaaatgccaaagtaggctcaaaatttggttcctag

SEQ ID NO: 6293 - DNA, 2913 bp, Homo sapiens
aataagcacatggacaagtgggcacagactcacaggccagatggacctccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtggggtaagcatcctcaggattctaaccccatcttccctgacaggccttgtagggttcctagaaaaattatacacaacggtataaaccctacgtctgtagactccagggtttctcattctcctcacccacccacacacagccaccaggaactagttcaaaagttctggcttaattttaccagtttacatggtcttcagggtacacataaaagcctggagcctgtgtgacctgcaggctttctgcatcccctgatgttgggtttgtagtctgccctgtgacctcagttctttaaagggctcaggagaaaccatccattcatttgaagtttctccagcatttttgtttgtttgtttaatgtgtaggagcaactctttgtcaggtctctatatctacaaacttaactcagaaactaatatttttaaatatatttcttttctatcatacttttagtgctcctctacctatgctaattgttcttcagtattttttatatttgtatgtctttatctattttaaaatcaggtttaattccttcttaatcaaattaataacttttcatttatttccctacgtaactttcttttcagacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatgaatggt

SEQ ID NO: 6294 - DNA, 4852 bp, Homo sapiens
tctctccgcctccggaagcgcgggcgcgcggcgccgggagcccgttcagggccgcgggagtgcgccagcgccgcgcgtggggctgtggtggccgcggctctcagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccgggaagcaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttactttgatttatttgattgaaccctggaagtattatttttaccagtcccacatttaaagacctagtaatcttgatggaattggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacctggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatataatctttttatatatataaaaaatcttttttataaattttattttaaaaatcttttaaaaaagatttttatatatatataaagattatatatttatatatagtcttttctgttcataatggcattagtctctgagtacattttatattatctttgttgccacatgtcaggatacaacacaatagttttataaataacaactgtactttgattttaggtactaatttaatgctttagtttttactactttgaaaggggaggttcatctaagtattactgataacagggatccaacttaaagtaaaagttggaaagggcaagagtcttttaagcggaacttcaattctgttgtcatggttacttatatataatgaatataaatagacaaataggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttattttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataa

SEQ ID NO: 6295 - DNA, 3284 bp, Homo sapiens
gcagctttttgacttgtaaaagtggtgaaggtttcaaagggacttgtcagtactgctctgtggaatggttggacttattttgcatccccttttcttgtaaagaatcgagattcaccgagctgagacttttctctttaagacagctagccatccactttcttccactgctaattgaccagtggtcgagcatccataggatttctccccagtgtgaaaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaa

SEQ ID NO: 6296 - DNA, 447 bp, Homo sapiens
atgagtgtccctaaattagtcaaccatggctgggagacagagccatgcaatccagacccagctcttctgctcactggggccgttcccggagaaggagaaaccacgctggagcgggcactcccacgagttgtcggggaacaagaactcggatcctggcgggagagagcgaacagtacacccgagcggcggctgtcacccgctttgaaacacgtaagtgcccggccaaccagcatcccagaaacgcctggggagcggggcgcgcggacgaggagagaccgcgctgggagggcgcggaagggcgagggcgctgccgcctccacgctgagctcactgcgcggggcggcccccgaggcagggcgcggggcggaggcgcccgagtggtccgtctcgggaggcgcagacgcggttcctctcgagggcgctcccgctgtgaggagcaaatcctag

SEQ ID NO: 6297 - DNA, 1744 bp, Homo sapiens
aaaacaaaaaccaccaaaaaaaaactgccaaagtataggttatagaagagcagacttacttggtgtttgcaagaaagacaaagagatttagagtttccatcaagtttgttgtgagttactaggaggtagtgccagagaagcaacatggcattaggctgcatgggtagaagtatagtactgagaacacgggagagcatcggttttgttgtacttgggactaaacattctgagggtcctggacgttttatgagaggctttggtaaactgaagagtgatgtaggtacagatgcacagatgtagaacagtgcccctgcgccagcccagcatcaatactttttttaaaaagtgccctgtattttcctcatgccctggagataatggagccgtcttttactcactgcccacttctcatctctgtctgctcctgcttcctcttgttggcttcctgtgcctccctccaaccttctcctacccccctgcagtgttttaaactctcttttcttcttaatttctgttcgcctcaaccaaccctaaagtgctcttgtactcacagttaggcttttataattgcttgatcagtttatcagtcaatttcagtattttgttgagctttgacaaagatttttattctaattctatggagcccatgtaataattgttttttcagcttctgcttgtgacttctctacttcaaaaaatgtacgtgcttgtttctgccagttacatcccatgtttcattggatgtgtgtactgtgttcacatcgagttggccccaccgctgagtgggttattgatgatctcaagagtccagtagaaatgaagggtagaaacttagccacatcctggtttgtgttttgcctaacagaggggtttcactttcctctttggtaagatgaatatgcttgataatagaatagcattaaggttggcttttttctccctcaaatgattaaactgtagtttcatatgtaaatgccagtaaattagaatcattctagtagggaagataaagtaaataagtaaaaatatagtatgttagtaggaaatcgtgctagagagagagagctcaagcaggacaggaggggcctagagattgcttgggatttgatgaagagacaggactgttttagagaggctgctcacggcagtgcctctgagcaggtagcactggagccgatcctctgctgcgatgaggtggcaagccaagaacatcatgagggagggaagggcagtcccagaagagagagcacagtgcaggtgccaggtggggaccacgggacactggaactgccttggtgtgtttatttccaaatagtgtctggcattacactgagatgaggagacttttttgtttttcattttttgtttttttttcccggggtaggggtgcatattggatttcttcaggagattcagcctcttgaaaaatatgaaatatagacaagtatatatacataaagatatatttgagtattttaaactttatatagccaagtatcttaaactctgcacacttgaatttttaatcctcgtgtatatccattatgattatttctattagttccagtttgaggttggtgatgatattgtcatagaagctttgtcaggcttcacattgtagcagctggtcttgaaggtggggcatatccttgttcaatgtgactactttagttgcctgtccaatatgaagtagaaaagcagatttctggattacagtatttgtcaacatagaatttgccgattt

SEQ ID NO: 6298 - DNA, 639 bp, Homo sapiens
gcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctggtaaacttaattctttttgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgac

SEQ ID NO: 6299 - DNA, 4628 bp, Homo sapiens
ccgtcgttggggaagaagagttactctcaccagagtgtcagcaatgggaccttctcttcggatgaggagaccctggaagacaatctaaggtccttcaactattctatgggaacccgggcattttcccatgacagtatttttatccctgatgggggagcagaaagtgagcagacagttcaagcaatgtcacaggacaacatcctgggcaaagtcaaaactcttcagcaacagttgggcaagaatatcaagtttgggcagcggtcacccaatgccattcccatgaataaggcaaacagtggagaggctagcttagaagaggatctgttcctgaccagtcccatggaaattgtgactcagcaggacatcgtcctctcagacgcagagaacaagtccagtgatacgccaagttctctaagtcctctgaatctccctggagctggaagtgagatggaagagaaggttgctcccgttaaaccgtctcggccaaaaaggcacttctcttctgctggcaccatcgaaagtgtcaacttagatgccatccccctggccatcgctcgcctggacaacagtgccgccaagcacaagctggctgttaagccaaaaaaacagagggtgtcaaagaagcacaggcgccttgcccaggatccacaacatgagcaaggcggccttgagagtcggccctgcctggaccagaacggacacccaggcgaggacaagccaacgtggcacgaagaggaacccaatccgctggattccgaggaagagagaagacgccaagaagactactggcgagaactggaggccaagtgcaagcggcaaaaggcggaagcagccgagaagagacgcctagaggagcagaggctgcaggcgctggagaggaggctttgggaagagaacagaaggcaggagctcttggaggaggagggcgaggggcaggagccgcctctagaggcggaaagggcgccgcgggaagagcagcagcggagcctggaagcgccaggttgggaggacgcggagcggagggagcgtgaggagcgcgagcgcctggaggcggaggaggagcgaaggcgtctgcaggcccaggcccaagcggaggagaggcggcggctggaggaggacgccaggctggaggagcggaggcggcaggaggaggaggaaggaagatgcgcggaggagctcaaaaggcaggaggaggaggaggctgagggatgggaagagctggaacagcaggaggcggaggtgcaggggccgcccgaggcgttggaggagactggggagggccggcggggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagccccgccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagaggcccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagacaattctagatcagagctacaagttcactttctgtctctgagaatctccatctagggcagtagttcttatgatgtgtaggc

SEQ ID NO: 6300 - DNA, 486 bp, Homo sapiens
ggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggttggaatgcagtggcacgatcttggctctctgcaacctccgcctcctgggttcaagcaattctcctgcctcagtctcccaagtagctgggactacagctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgt

SEQ ID NO: 6301 - DNA, 512 bp, Homo sapiens
ggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagaccca

SEQ ID NO: 6302 - DNA, 2597 bp, Homo sapiens
tcttggctcctcttggcctctgcagccttgctggaggctgccctgcggaatctgagtgaataagggaaacagcaacagtcacgttggggaaaagctgattcggacagcgccactggttcctttaacgcacgaccctcaatgcagcgtcccacacacgggattgtagaggtcccgagtttaagatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgag

SEQ ID NO: 6303 - DNA, 754 bp, Homo sapiens
caaccaagccctccagcaaggattcaggttgttgagtgcttgggagggacacccgcctccactctgcaagaactcataaagggagatgaggggatcgtgggagggagggaggagggtgccactgatcccctgaacccctgcctccgcctccagggtgcccctccggcctcgccatgaggctcttcctgtcgctcccggtcctggtggtggttctgtcgatcgtcttggaaggcccagccccagcctagggggctccagaagtctccaacccctttgatggcctggaggagttaggaaagaccctggaggactacactcgggaattcatcaaccgcatcacacagagtgaacttcctgccaagatgtgggattggttttcagagacatttcggaaagtgaaggagaaactcaagactgactcatgaggacctgaagggtgacatcccaggaggggcctctgaaatttccaacaccccagcgcctgtactgaggacgccctccatgtgtgtccaatgtggtcacacgcccaggtgtgaccaataaaaatcctatggaaaattctctctggccaggcatggtggctgacgcctgtaatcccagcactttgggaggctgaggcgggcggatcacaaggtcaggagattgagcccatcctggctaacacggtgaaaccccgtctctactaaaaatacaaaaaaaatagccaagcgtggtggcaggcgcctgtagtcccagctattcgggaggctgaggc

SEQ ID NO: 6304 - DNA, 700 bp, Homo sapiens
ggccagttgccgggtaacggagcggagcggctcccggcgcgccgcctcccgccctccgcggagtggcgctggggccgccgccgccgctttacgtaaggcgcaggccagggccgcccggcgctcggcagccgcccgcagcccctcggagccagaggagaggcgcccccgccggccgccgcgccgcccggcagcctcggcaggttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacag

SEQ ID NO: 6305 - DNA, 1243 bp, Homo sapiens
actgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctggg

SEQ ID NO: 6306 - DNA, 2927 bp, Homo sapiens
cgcgccggttcggtccccggggctctgcgggcgccgggcagagacctgcggccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccagatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgtt

SEQ ID NO: 6307 - DNA, 1494 bp, Homo sapiens
gtggttttaacatagactctaaacagcccccagcacaggggcagtgcagaggtggtgtgattttggggaacaagaacagccttggagacgatcttaaatgcagtccaaccgtggctgatgttggagccctaagcaggggaaaaagctccacaagaaataggaatttccagggctctgcccaccgggagctgtgttcatacacagggtctgggggttgatttgtattggggtgtttttccacagacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcg

SEQ ID NO: 6308 - DNA, 1668 bp, Homo sapiens
gtggcctttccaagcggctgccacctcaggcttgggtgctggggagggctccaggctgcctacatctcaccaccggagcctgagctgccggggctatgggcacagggtgccgggcagtctgggctctcgctgctgcccagcttctttccagcctggcgaatccatctgctcaggctggcacttctgcaaagcccggcagcacagtgtgtgaacagcgtggccacaaggcgggactgccggaccccccgacgcacgccatgttctggcagagcgtggcctgagctgctgctccgggcctcaccctcgcccgtgaggagcagatagcaggcacccacctcgggactgttggaagatggaacacgctaacgcatagggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttca

SEQ ID NO: 6309 - DNA, 5119 bp, Homo sapiens
ctccggagccgtcgccagggtggtaatacctggtgcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttggttactactgaatgcccacagaaaggaagaaacttctctctccctttagacaaagtcgaattcttatcgcagctcataaaatcctttatgaaactggaaaaaggtgttcaagaattgtttgacgaaatacttttatcactcaagataaccagggatacttcaggaattttggagaaatccgatagagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacaagtttccgacacagaaaataacctgaaccaaggacccagcttgatggaagccatctttaaaatattgtaccattgcagtttttctccacaaacatttgcaaacgtttttgtgagctacatggaagaagagcaattatgggactttttatataacatcccagtctcaacgtgcgtggagtacgagctagaggtcatccgatgcttgagactggcactgaccgatgccatcaaggacactgtacagcagatagtatctgtaatgagttctaggagaaactgtgagacaaacctaaacaagcacattgttcctgattgtttgcttgagagcatgccaaaggaatggaattatagtccaaaagaaactaacaggaaagaatcatgcaaaagcttcacaaggcttactgctcaggcagtatctattgtaatcagcaagttacctacggtgattgcatgtttgcctcccccagttaaatacttcttttttctgtctgagagaaaaatgtcaaaaaaatttgttgaattgaagaaagctggcctgcttgtctggaacttgattgtaattatatgtcggatatttgaggacggaaacactgtggaacttttaacaggtgcctctcttgacagatggagtaaagaaaaattgggtttaatttgtatgtgtttgaaaagcatcatgggagaccagacaagtatccataatcaaatgatccaaaaggtcatacagagcattgagcagcagaagcccaactggattgaacgtcaattgttgaaagcaaggaaactgagcactgaatgtgcatttatgacaatagagaaaagcacggccttacaagaaggagatgttgctcttgaactgactgagcagaaaataaacacgatggtcctggatctctgccacaaaccaggtggcagggagtacctgaggcaaatttatcacatcatgcagctcaatgaggaatatttaaaagaacagctgttttctatgaatagttcagaggaaaagccattacccatccgacctttaaagacgaccttgaggagtatagaagatcagccttctgcctttaaccctttccatgtgtataaggcgtttagtgaaaacatgctagatcagtcagccatcacaaaatggaactggaattgggcaaagttgctgccaaattatctgagactggataagatgaccttcagtgtgctgctcaaaaacaggtgggaaatgaagaaggatgaaacactagaagaggaagaaaaagcaatactggagcacttaaaacaaatttgcaccccacagaactcttctgcctcagataacatagaggaacagtaatctgcagaaaacagcaacagctttattttaggaaacaatcccatgtaatggagtaggattttttaccatagtcagaatgaacctcatatgtgctgtgaagcatgaaaccaatgactgagtaatctctgtactgaaaaggaatacagcacataaaggataaggtgctacatatttttttattttaaaaataatttcaaatgtttttctttccccaatctttctctttatatgatataactgctgccatctcgtgttccctttgaattatttttttctcctttcagtcttgaagtatctatgacaacaggaagaaatgttcagaaattttttaaaggattttttaaatacaacatttggatgttaagttgagtggagtcacatagccccaggaggtcatctgaaatttttaatttaattttgttgtagctgtagcccaagtcccaattttaattgcctttactatccacaattgtgtcaactttcctcattcaatttatctaattatagtcaaaaaaaagcattctcctgaactataactttagtcacacctctgcttgtagtggttttcagtcttcctcctaaaccagaatcaaatttctactcatacatattcaggtcctataccaaatggctccatgttcagacaattgcttgccatcctcttggttcaagtcacatgcttgccatgttttcccaatcagaatccatctttcttccaaaattaggctcaaaactaattccagcaatctttaccccaaagctcattagctcatataatgtgttactttaaaattttttcattgtattgatacacacacacaaaataagaaaacagaacatgctctagtaccctctctgccaaggacaattatagatatttattatttccttcctatcactgcctgatattagattataaagacattgaagatattatgatataatatgaagtctccctttataactccctgtatgcctactacagtgttatttcatcaagtggacagttaacgaacacaattgattaaatagctgccaatg

SEQ ID NO: 6310 - DNA, 905 bp, Homo sapiens
gacgataccatcgcttcagcagcatcctctcagacaagagccactatttctgattcagatcacctgtcatcgaagtttaaagaaggggaaacaggagacagaaatacactgaaccaaaaagattcaaaagagcaagtggaatctctaagaatggcttccagccactggaatgaaaccactacctctgtttatcagtaccttggttttcaagttcaaaaaatttaccctttccatgacaactggaacactgcctgctttgtcatcctgcttttatttatatttacagtggtatctttagtggtgctggctttcctttatgaagtgcttgactgctgctgctgtgtaaaaaacaaaaccgtgaaagacttgaaaagtgaacccaaccctcttagaagtatgatggacaacatcagaaaacgtgaaactgaagtggtctaacactctatagaagatgaacaaaatctctgaaagcagctcaacctcttctgagaaaaaaaatatattctgaggccaactgttgctacaaaacaaattctgactgaatggttaaaacatttctagtagaaggggaaaaaaaagttaaacatgcactgtttgtgtgtatagccatttcattaaatatacagtaaaacttcatgaatgtgaatttactaatctgtttaatactgacacttcaaaaactggataaaagattcctagagttcaatattaagcagcaaaagataagctggaaaagacaagcaaggctaatgatgctaaaatgattttataactaaccaattcatgtagacaaaaaatagtgtgttggtaacaaaaaggctatttaaaacatgtttctaagtctgaagtaaaatacttccacttatatatataaagttcctatttattaaaaagtagtattttct

SEQ ID NO: 6311 - DNA, 894 bp, Homo sapiens
ctcgccccccgccgccgccaccgcggtcagccagcggaccagcggcaggagccgttccccgacgggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgta

SEQ ID NO: 6312 - DNA, 396 bp, Homo sapiens
ctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaatgctcaacggagccatgttcttcaaccgcctgtccttggagtttctggccatcgagtaccgggaggagcaccactgaggcctggggagtcggaacagggctaaggagggggaagcaaaaggctgcctcgggtgttttaataaagttgttgtttatttcca

SEQ ID NO: 6313 - DNA, 7393 bp, Homo sapiens
cggtgctgcgcggatccggcgtcggggcccggcatggcgggggccggggccaagccgggccggacccggacctaaatgcctctgttcttctccgcgctgttggtcttgctgctagttgcgcttagcgccctctttctaggccggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggcaatactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatatttt

SEQ ID NO: 6314 - DNA, 6004 bp, Homo sapiens
agcaatggtacattaggagcagcatctaatgtttttgaatctagagcaccagaaggtaagaagctggatgagaggataatatttgatgcactaaagctaagcagtgatgtgcagaagtcagcacctgtgccacccagaaggcggccaaatgcagaacgcaaagacaatgttaacaggagatcgtggaagtccttcatgccacccaacttcccagaatttgcagagaggatagaagcttctctcagtgaggtttcagaagctggtgcttcaaatccttccttgcaagagaagaaggagtccagttctgcattaacagaaagttctggtcatttggaccacagggaacctcagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatcccaggatgcagaaaatttactcgtaattagtcatttttcaggggctgccttagaaaaggaacagcatttaggccttttacatgtaagggcaaaagattatgatactagattggattgtggatattttaataccctggattcttctcaggtgcctaatgctgtggaacttattgcccacgttgatatcatgagagacacttccactgttagcaaggaggaatgtgaaaaagtgccttttagccccaggactgcagaatttaagtccagacagccagctgatctggattcactggaaaagctggacccaggaggactgctgaactctgatcacagggtttctcatgaagaaaaattatcaggcttcattgcttctgagctggccaaagacaatggcagtttgtcccagggagactgcagtcaaactgaggggaatggtgaggagtgcattgagagggtcaccttcagttttgcttttaatcatgaactaacagatgttacctcaggacctgaagtagaggtgttatatgaatcaaatttactaacagatgaaattcatttggaaagtgggaatgtaactgttaatcaagaaaataacagtctgacatcaatgggaaatgtggtcacttgtgaattgtctgtggagaaagtttgtgatgaggatggtgaggcaaaagagctggattatcaagccacacttttggaggatcaagctccagcacatttccacagaaacttcccagagcaggtcttccaggatctccagaggaagtccccagagtcagagattctgagtctgcacctgctggttgaagaactgagacttaatccagatggagtggaaactgtgaatgatacaaagcctgagctgaatgtggcatcatcagagggaggggagatggaaaggagagattcagattcattcctaaatatttttccagagaaacaagttaccaaggctggtaatactgaaccagttttagaggaatggatacccgtcctccagagaccttcccggactgctgcagtacccactgtcaaagatgccctagatgctgcactgcccagcccagaggagggtacctcaattgctgcagtgcctgccccagagggaactgctgtagttgctgctttagtgccctttccacatgaggacatcctagttgcttcaatagtctccttagaggaggaggatgtcacagctgctgcagtatcagccccagagagggctactgtcccagctgttacagtatctgtccctgaagggactgctgcagttgctgcagtgtcctccccagaggagactgctccagctgttgcagcagccatcacacaggagggtatgtcagctgtcgcagggttctccccagagtgggctgctttagctattacagtacccatcacagaggaggatggtacaccagaagggcctgtcaccccagctaccacagtgcatgctccagaggagcctgatactgcagctgtcagagtgtccaccccagaggagcccgcctccccagctgctgcagtgcccaccccagaggagcccacctccccagctgctgcagtgcccaccccagaggagcccacctccccagctgctgcagtgccccccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccgcctccccagctgctgcagtgcccaccccagaggagcccgcctccccagctgctgcagtgcccaccccagaggagcctgccttcccagctcctgcagtgcccaccccagaggaatccgcctccgcagctgttgcagtgcccacccccgaggaatctgcctccccagctgctgcagtgcccaccccagcagaatctgcctcctttgcagctgtggtggccaccctggaggaacccacttccccggcagcttcagtgcccacccctgcagctatggtggccaccctagaggaattcacttccccggcagcttcagtgcccacctctgaggagcctgcctccctagcagctgcagtgtccaacccagaggagcccacctccccagcagcagcagtgcccaccctagaggaacccacctcctcagcagctgcagtgctcaccccagaggaactcagttccccagcagcttcagtgcccacccccgaggagcctgcctccccagcagctgcagtgtccaacctagaggagcccgcctccccagcagcagcagtgcccaccccagaggtggctgccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgaggtaattgtccattttgattctgggaagggtctaaagagtaaagtgagatttgcagggctgacctggtggtgatgagaaatggcacagatagttcttttgttctttttgggtctcccgggcttatagtttgtagtctttctgttcagtttttggggaaaatatactttaattttgtctggtgaaagactttataatttcatgcttcgttttttattcagataagccaatcccacggaaaacagggatataaacagttgttgatttacatttttaaaaagattattagcaggaaagggtcattctgtttttgaattatacagtgagcatgttcttgcctaaaccaagagacagtttattcattggtggtgtcaacatttaggtagaggccagagtgtgagctttggaatgagacctggggtgcttcctaaccactctgggaaaattagttagctattcttgagtttcctgtttcttcatttgttaaggcataactctgtgaggataaaatgagatacatttaaggtaccaagcgtataagattaccaatcactggccatatcctccccattcttttcaaataggtatgttggttggttgaaagaatttaccaaagtagattggagagaagcaataaagctaaatgattaagaacttttaaatgcaaatatgtgtttctgaaaaccagagctaggcataatgtttatgaaaaatagagatattttagtcatctttgtcaaactgcctttgtgtccttaagcaagtcattttcctttccaggacctcatttcttcattataaaacaagaaaattgggctaaatgtcctcttgggtctctcttggctctaagattctttttattttttttttttagatggagtctggctctgtcagtcaggctggagtgctagagtgcagtggtgcgatctcagctcactgcaagctccacctcccgggttcacgccattctcctgcctcagcctcccgagtagctgggactacaggcgcccgccactacgcccggcaattttttgtatatatatatatataattttttttttttttttttagtagagacgggtttcactgtgttagccaggatggtctcaatctcctgacctcatgatctgcccgcctcggcctcccagagtgctgggattacaggcgtgagccaccgcgcccagccggctctaagattcttaatgttagagaaccgaatgtgttaggaaacagttggaaacgatgttccacatccttgagcactcctagtccaaggaatttgagatcagcagctttccacagttaattacccaggtttgatttggtcagtggtaaagagtgcaggagttagaggtttaatctgaacacaagagatgactgagtgagaagattgttttgattttactgcgcccctaggactcaaaatagtgccttcttcatagcaggcatttgctgttgactgactgactgaatgcatgaatatcaatttcctagactatggatggatgctacaagaaagatgggttttctcattcacctcactgcagagcctttcagggcagccttaagtcagctagagcaccagctaaacatgcaggtcctgacaacaaaatcattttgattgcatgccataaactctttgattaagaggattgattaagataatctggccttgctgagtggtggtggttttaccttgagctttaccagttattttgtcaggtagcattccattaaattaggatgcatcatctttgagactgatggatttttgattcatttttccgagttttattgaatttggaatgacaccgagatcccaatagcctgtacaaagtgaagacagtaggtcaacaacagagccattcttgataatacagaatatttcacaccaggcacagtggctcacacctctaatcccaacatttgggaagccaagggaagaggattgcttgaggccaggagttcgagaacagcctaggcaacatagtaagaccccatctctgag

SEQ ID NO: 6315 - DNA, 791 bp, Homo sapiens
acggcatgtgcctgtattgctgggacatcgagccttcccaagtcaaccctgaaggaccaagacaacatcatccttcagaggtcactgagcggcagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattattgctga

SEQ ID NO: 6316 - DNA, 1948 bp, Homo sapiens
cccctttctgctgttaccgggagcgcggtggccacggaacgctgcccggagccgcgcgagggaggacccgacgcgcggcgtttacccagcgcagcgttccaccgctcgggtttggctgggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaa

SEQ ID NO: 6317 - DNA, 459 bp, Homo sapiens
gtgaggggtgcctctgcccggccacccctactgggaagtgaggagcccctcagcccggccagccaccccgtccgggagggaggtgggggggtcagccccccgcctggccagccgccctgtccgggagggaggtgggggggtcagccctccgcccggccagccgccccgtctgggagggaggtgggggtgtcagccccccgcccggccagccgccccgtccgggaggtgaggggcgcctctgcccggccgcccctactgggaagtgaggagcccctctgcccggccagccgccccgtccgggagggaggtgggggtgtcagccccccgcccggccagccgccccgtccgggagggaggggcgcctctgcccggccgcccctactgggaagtgaggagcccctctgcgcggccaccaccccgtctgggaggtgtgcccaacagctcattgagaacgggcca

SEQ ID NO: 6318 - DNA, 1837 bp, Homo sapiens
aatgttgcctggcaacagggaaggggcggctctcgagaggagcccgtgggctgctggaccggaccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaaggaacctggagtagataatgaatgattcacacgacatttggggacatttctaacttgagatgaacatcagaggagagagatagcctgcctcgtgtgtctcttgaaccacgtccctcctgactgccctcccagagatggggagacagacgcggtgatgggtctgccctcctggactcgtcggtccaggaaccatgacgtgtcaggtgcaccgttgcctctagaatgtaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgacatgaagctgcaagatggcaagagacttctggggccccagtggctggactatgactgtgaccgagctgtgatcgaggactgggtgttcagggtcccccatgtggccatattcctgagtgtggtcatttgcaagggctttctcatcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggtgcctgctcttttcgtctgagctccatggacacagcttctcccagctctgtggccacatcactcaccggggaccctgtgtggctgtcctcgaggaccatgacaagcatgtgttcggtgggtttgcctcttgctcttgggaggtgaagcctcagtttcaaggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaacgcctgcagcccctcttccctcccacatggtttaactgtaatagcgtaccgcacgggtcacagcct

SEQ ID NO: 6319 - DNA, 2930 bp, Homo sapiens
gttgcgatggcgcagaaaccccgttgacaaggcactgctttttcatgacgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgc

SEQ ID NO: 6320 - DNA, 7296 bp, Homo sapiens
atggtggagcagggagacgcggcgccgctgctgcgctgggccgagggccccgccgtctccctgccgcaggccccgcagccgcaggcgggaggctggggccggggcggcggcgggggcgcccggccggccgcggagccgccccggaggcgggagcccgaggagccggccgccccggaggtgctgctgcagcccgggcgcctggagctgggcgacgtggaggaggaccaggtggtggccgtgttcgtggtcaccttcgacccccgctcgggaaacatggtagaatggtgcttacctcaagatattgaccttgaaggtgttgagttcaagtctatggccagtgggtcccataaaatccaatctgatttcatctatttccgaaaggggcccttcttcggcctggcctgctttgccaacatgcccgtggagagcgagctggaacgtggcgcgcggatgaagtctgtgggcatcctctctccctcctacacactgctttaccgctacatgcacttcttggagaaccaggttcggcaccagttggagatgccaggacattactctcatctggctgccttctatgaggacaaaaagggggtgctccatgctggtcccggcagaggcagcagcctgccccctgtctactggctgccttccatccaccgatacatgtaccctgagatgaagatcacacacccagctggctgcatgtctcagtttataaagttctttggagaacagatcctcatcctctggaaatttgccttacttcgaaagcgcattttgatattttctcccccacctgtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccacttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcttcttgcctctcaagggttgaggggtcctttctgtcaagtaatggttatttttcgtggtatcctgaggttcagggtgttttaagctgggggtaggtggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaa

SEQ ID NO: 6321 - DNA, 2366 bp, Homo sapiens
gccgaccgcgttcctatggacagacgcacagacacctgcaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagaccaggatgaaagagcagctgagctcagcagggagcagaacgagaaaaccatccggagcacgcagaccgcgctccgcaatttcccttattccactaagctcaacaaatttcctgtatttaatattaatgatgacttgaatgatctgtgtaccagtgcagtaagcccaaatactaccaaagccacgcggtacgccttgaatgtgtggcgttattggtgcatgaccaacgggctcaaagaccacacagacatcaccaagatccctgcagtgaagttgaacgagctgctcgagaacttttatgtcaccgtcaagaagagcgacggctcggacttcctggccacctcgctccatgctattcgccgaggcctggaccgcatcctgaagaatgcaggtgtcggcttttccatcaccagcagcaccttcagctcctccaccaagaaactcaaggagaagctgtgggtgctgagtaaggcaggcatgtcgggcgcgcgttctcgcaacatcgtctacttctccctttctgacgaggaggagatgtggcaggcagggtgtctgggggatgacagccctatcactctcctgtccactgtggtcaagtacaacagccagtacctgaacatgcggacgctgcaggagcatgcggatctgatgtatggtgacatcgagctgctcaaagacccccaaaaccagccctactttgcccggacggacagcgtcaagcgggagagtcggagcggctccaccagagtgtgtcacgggaagatctaccatgagcattcccggggacacaaacagtgcccttactgcctcctctacaagtacatgtacatccaccggccgcccacccaaatggaggccaagtcccccttctacctgactgccaggaaggaggccacagacatgggcagcgtgtggtatgaggagcagaggatggggctgcgctctcttcggggaattgtcccaaacttagccaagaaggtcaagctggaaaactgtgagaacttcacctttgtctcgttcactcaggtctcccggaggcttggctcccacagctgctgccagtgagcccccactggggcccggccactgccctgtcacctgctcgggccagccagggttggagcagctgga

SEQ ID NO: 6322 - DNA, 108 bp, Homo sapiens
aaagaaaagaaagaagaaagaaagaaagaaagaaagaaagaagaaagaaagaaagaaagaaagaaagaaagaaagaaagagaaagaaagaaagaaagagaaagaaaga

SEQ ID NO: 6323 - DNA, 459 bp, Homo sapiens
gtgaggggcgcctctgcccggccgcccctactgggaagtgaggagcccctctgcccggccagccgccccgtccgggagggaggtgggggggtcagccccccgcccggccagccgccccgtccgggagggaggtgggggggtcagccccccgcccggccagccgccccgtccgggagggaggtgggggggggtcagcccccctgcccggccagccgccccgtccgggaggtgaggggcgcctctgcccggccgcccctactgggaagtgaggagcccctctgcccggccagccgccccgtccgggagggaggtgggggggtcagccccccgcccggccagccgccccgcccaggaaggggcgcctctgcccggccgcccctactgggaagtgaggagcccctctgcccagccaccaccccgtctgggaggtgtgcccaacagctcattgagaacgggcca

SEQ ID NO: 6324 - DNA, 1158 bp, Homo sapiens
gtgggaagtgcggctcctttcgcgtcccccaccctctcggctccgcctggcagcagctccgccgcccagaggcgtccgagaccctccgactcgtgggtacgcataggcctcgccagcgagccttgcccaggcaacgagtcgccagcccgccccctcgccgcgggctaggtctcacctcgccaccagtacgtcttggacaagtagtgccaggtctgatgccgggtgtggtgagtgccgccgggacccaggtgcgccgcctcgatgaggtcccggcgtcgctccggctgcagcaccacctccagctccgcgaaggtcttgcggtgccgctgccgccgctggtaatacagagtcccgccgcgcaccacgtagcaggcggcagcttttcggattttacgcttgacattgccctcggtgcccggcgcatacggctcgcgctcgttcgtcaggtaacgcaggatggcccggtagctttcctcgcttgacatcgcggaccgcggctccctgagggcgcctgtcagggacaggtgaggaaaacggcccgctacctacgggcggctgcaggaggagcggcggcaccgtagggagaaacggctgcgcctttggcgagcgctcttcgacggctcccttagtccgaaggaaaagcgggcgagttggtaaccagggggaactgcacttctccagcgcgcgggatccgctggcgactgacaaaatggctgctgcaccaccggaagtgacgcaaggcaagggcggggactgagccctgattggagcgcactctcgttttctggcttgatggagccgatccagtgacgtcaggaatgcgggtggacattttggaagcgggtaggacccttcactgcagttcgagggagtctttaagcagacatcttaagtcctggcagtttctcttttcatttttcccttttccacgctttctaaggagccacgtgtagggggagctggtggacagttgagagttcagccgaaacatccagagggttaggagtccgtttttacgtttgagactcccaacatcataaaagcatattttcaggcttctggaaaaatattagtctcttgacacgggaccagagacagcccatttacatggaaatttagattccagttaacagttataaaattttcagtgcctccctc

SEQ ID NO: 6325 - DNA, 2689 bp, Homo sapiens
cacaacgctcctcagatagggcactcccccagcaggggtacagcttggctccgggacctcggtcccgccgaggctggcttcagtttctgaatttgcccaccagtggcttcgagggccaagcccccaggccctgctggtccaggaggagagacagctgcctgcgagcctcctggcccagtatggcgagcgctcgtccaacaggaggtcaaagccggcgctcaccaacgctgcgcagcgctgctcatgggtcaggatgttctctgcgccagggcgagagactgcaggtagaagggggcccacgcctctcccctcgacactacaagcctgggtccgggaatgctcacctacctacgctcaggggggccagtggaggccggctggaggtctggggggactctgaaagaggcaaggagggcgggctggtgtgggtgccaaggcccaccctccgtccctcaggaagccaaggaggcggggagaggaagttttcatcttccagacacaggacattacacgagctgctcttctagcggtccctacccccggtgtccccagaggacgtgaaagcagggaccggcacatgtaccccgccccagctccctgcaggtgacgtcctgatgctcagatggtttgtacagcaacccacctcctgctcacacgcacagccacttccgcctccccacgggactgccagcctcagtcctcttgtccccagctgcggctcagctgcctggccctccctccattacctgggttctccagctgactccggatgtagcagagggcagagagcgctgcctgctgtttggcctccgtcttgctattcgcagtgcccgcagggcagaccaccccatccagttccgcgctcaccgagaaggggaagcagggacctggggaaggagccaggtgaggaagcagccccctggccttcgccctgtgacagcaggctccatcgccaccccatgccgcgcacacccttgagtgcctctgcaggctgtgacccatcgctgattcaaccaagtcctcacccaactcctccacagcagggatgcgtgactccatttcacagatgagcagaaacggcaggcggtttgcccaacttgagtcaggacccaaatccaggtcccctctccagagcccacgccaccctgttctcaggaggaaggctctgagcacttccacctgccacagacacattgctttcaattcctctcctccaggggctctatatttgaacacttttcctatgaaacagtatcattttgggtgttacttataacacaaaagagagatgaaaaatctggaactgggatcacatggtcaaaggtgcagggttaatttcacagtacttgctgctaaattgtttctcccaaggactgcccctctgggggtttcccttttggaagggaacccatttcagcactccccactgcgctgagatctgtctgctctaaacaggcatcaaaaccagcaaccacagacagacgtggaagggatgttggccttagaaagccagcatgtggctgccatcctaacagcgactgaatctggggagaaccatcaaagcatgattttctaaaaccacaagtgacaatgttatagggacaggatatctacatgatctccaaatgcctcccctggatgacttattcagcacaaaggagaaagtgaagacacctggtagatgccaccctagtcaaatccccacagctcgcatcgccaggggacaaagcaagatcgcacacttcctggtgagatgcgtgccaaagactcgacatcacttcaataacacatcacctgaactcagttctgaggaaacagacaaacccaagctgaaggacattcgcaaaactactggcccttactcttcaaagacatcaatgttgtgaaagacaaagacaggaactgtttcaggtaagagattaaagaggcatgacagctaactgtaatgtcatactgggatgggaaacaatggccatgaggtcattactgggacaactggcaaaatttgaatgtgaatagaaattagaagatggtattatatcaatgttaaatttccaggatttgataattgtattgtagttacataagagatgcccttgtttttaagaaatatagatgaggccgggcacagtggctcactcctgtaatcccagcactttgtggggctgaggacaggaactcaagaccagcatggccaacacggtgaaaccccatctctattaaaacacaaaaaaattagctgggcacgggggcacaagtctgtcattccagctactcgggaggctgaggcgcaagaatcgtttgaattcgaaaggcaaaggttgcagtgagttgagatctcaccactgcactccagcctgggccacagagcgagactctgtctcaaaggaaaaaaaaaaagagggctgggcaaggtggctctaacctataatcccagcactttgggaggccaaggcgggcggatcactagaggtcaggagtttgagaccagcctggccaacatggtgaaaccccatctgtactaaaaatacaaaaataaattagccgggcttggtgtggacacctgtaatcccagctactcaggaggctgaggtaggagaatcacttgaacttgggaggcagaggttgcagtgggctgagatagtgccactgaactccagcctgggccacaagagtgaaactccatctc

SEQ ID NO: 6326 - DNA, 3750 bp, Homo sapiens
ttccacaagccacagcattgtcaaatcagcccgaggcctttgcagatcatccaccagcctcagttctctcccttgcatctccctgtcattctccatcttcttctttgccttcatctccttctacttccacatccttttcttcagcctgtatactgttttcttcctcctcatctattctttcctcttcttcgacttcctgttctacttctccatccttacctccttcatctatccctcttttttcctctcctttgcattcatcttcctctccaggtttgcctccaacttatttagcttttccctctccagtttctcctgtttcttcttcctttatgatttcctcttcctttccccctattcttcactctccttctgtttctacctccccatctccttttattcctatccaccccttcaatcctcctcattgggggaagaaagtagagaagagaagagaagaaagtggagtagagaagaaaggaatagagaagaaagttgagacacgacaactttaaagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaatttggtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagaccattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcagtgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattg

SEQ ID NO: 6327 - DNA, 456 bp, Homo sapiens
ctcccccttttctgttcatcaggcatacttcaaaaagaattctggagaaacagaattcagtataaccagagtcaaaaggatatcctccaatcatggtttcaacatgaccctttccctgataaagctgccagagaacaactggccaaagaaattggggttccagaatctaatattcaggtttggtttaaaaattacagagtaaaacagagaaaactggattataagtgcttctcagaaaaagatcaaacccaggggcatgaccagtcccagcatctgactcaagaatacttacctaaagaagcccgacaaaaacagacattcatcacatggactcaaaaaaacaggctagtgcaagcctttgagaggaacccattccctgatattgctaccagaaaaaaactggctgaacaaacaggcctgcaggaatcaagaattcaagtaagttctatgtgtgtg

SEQ ID NO: 6328 - DNA, 5138 bp, Homo sapiens
atgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcggc

SEQ ID NO: 6329 - DNA, 4117 bp, Homo sapiens
ccgtcgttggggaagaagagttactctcaccagagtgtcagcaatgggaccttctcttcggatgaggagaccctggaagacaatctaaggtccttcaactattctatgggaacccgggcattttcccatgacagtatttttatccctgatgggggagcagaaagtgagcagacagttcaagcaatgtcacaggacaacatcctgggcaaagtcaaaactcttcagtcgactaagcagtatgttcctgcaacagttgggcaagaatatcaagtttgggcagcggtcacccaatgccattcccatgaataaggcaaacagtggagaggctagcttagaagaggatctgttcctgaccagtcccatggaaattgtgactcagcaggacatcgtcctctcagacgcagagaacaagtccagtgatacgccaagttctctaagtcctctgaatctccctggagctggaagtgagatggaagagaaggttgctcccgttaaaccgtctcggccaaaaaggcacttctcttctgctggcaccatcgaaagtgtcaacttagatgccatccccctggccatcgctcgcctggacaacagtgccgccaagcacaagctggctgttaagccaaaaaaacagagggtgtcaaagaagcacaggcgccttgcccaggatccacaacatgagcaaggcggccttgagagtcggccctgcctggaccagaacggacacccaggcgaggacaagccaacgtggcacgaagaggaacccaatccgctggattccgaggaagagagaagacgccaagaagactactggcgagaactggaggccaagtgcaagcggcaaaaggcggaagcagccgagaagagacgcctagaggagcagaggctgcaggcgctggagaggaggctttgggaagagaacagaaggcaggagctcttggaggaggagggcgaggggcaggagccgcctctagaggcggaaagggcgccgcgggaagagcagcagcggagcctggaagcgccaggttgggaggacgcggagcggagggagcgtgaggagcgcgagcgcctggaggcggaggaggagcgaaggcgtctgcaggcccaggcccaagcggaggagaggcggcggctggaggaggacgccaggctggaggagcggaggcggcaggaggaggaggaaggaagatgcgcggaggagctcaaaaggcaggaggaggaggaggctgagggatgggaagagctggaacagcaggaggcggaggtgcaggggccgcccgaggcgttggaggagactggggagggccggcggggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagccccgccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagaggcccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgcca

SEQ ID NO: 6330 - DNA, 2745 bp, Homo sapiens
gagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtg

SEQ ID NO: 6331 - DNA, 2512 bp, Homo sapiens
actgagacatgctgagcaaaggccggagccccagaagaaaacaagtacagactcagaggaaagctgccctggtcctgagtgtgactcccatggtccccgtggggtctgtgtggttggcaatgagctctgtgctgtcagctttcatgagggagctccctggctggttcctgttctttggggtcttcctccccgtgactttgctgctgctcctcctcatcgcctacttcaggatcaaactgattgaggttaatgaagaactgtcccagaactgtgatcgccaacataatcccaaggatggctcttccctgtaccagagaatgaaatggacgtgaagttggggactttccaataactaaagcacaatgagtttctactggtcagcaagcaatggccaacagttcagctaataaagtaggttgataaactagaaccatagcaaaatagaaagaatactaagatactcattctgaaccatactgaaaagtggcagctattatctaaggggacttctcagagactcagtataacagcagctcttgaaaagtaccaagaatggatttcctgggtatatacactggacacattgtaactttttaacttttattgtgactgtgtctgctctaaacggcatatttaaaaaataaaattctgcagcatcttactacataatcccataggaacccctattattccgattttagaggtgaagaaaccttggtagagatccaatgaatagcaaaagatgaatgccttggagagagctcagtagattccatatgcaagaatatttccacgttcttcttgcagttcagcaactcttaagtgacacagttcaggtatcatttttggacctgactttgcttctctccttttcctgattgctttcacaaatcattattgtcacaaatatgcacaaaacaagtggagtatccccacactaggtatggatcacccacaaatgtagctttcagcatgatgcgacctggaaatgttggcaatttggtaatgggaaaaggaaagggcagaatgttcacataattcctgaggaggagaatacaagtctttgcctgtaataccaaaatacagggagctatatctaactatgcggataagtcaacatttcactacagttctttttcagtgggagccccaaagagacaacataggtaattgaaaagaaacttaattctaggggtagttaaacgagattgtggttactgttgtgctccccacattcttccagttaacataaatcaaagatgttcaatgcattctaagtgtaagactggttacattccaatctttgtgcaggacattaacaggctgagtgatccactttataaaacataatgaatggggtcacctgtaagaaatgcacctgtttcagtagtggcttacagtcatactaaaggttgtgtggatgacccaaagcaaaaatataccatcagtgctggatttttactgcttcttcccctcagccccaccctaaaattcttgatacccattccgtgagtagtttccatttgcacttcttgcataatataaaacttattgctagaataaagacactcacttctgcattttactgcacttgattacaatgaaaatgtctgccggggttttcagactgaactaattcagagtaacagtgctcttgccatatggaaggaataacaatattctttcagttttgggagagatctctttttagcccctgggggaaatcagcttatgtaaaaatgctttctttaacagaaagtgtgaaaggacagatcgtattcctatctcaggcagctgccagccacatttgtggctcagctatcaaggtttgctccatcttcctccaataatgggcacttcagaaggccagttccagctctggtgggtgctggtccaccatctcagctattgtgataacacatgagctctatatagacatgttttcagcaccaagcactaccaagtactttagaacaaggcctgtttcttttctgccatccaatgagagcagagaatctccaatgaaactgactagatttatgaatgttttttatatgtagagaggggcagaaacatgttcattttcccatgaaggaacaagtcccaagggtttatcatctgcctgaaggcactgctaacgaatttgtcaaatcctttatccagcacagctttaccaagcagctgcacagtcaggcctttgcacttctcattctcataggtccagtttaagatctcattcagtcctgaactgcttcggtcctttgcattcctgctgtcttggcctccacctagaccaagtcggcagtctccctacattaccctacattcagctgcatcctatgctccaaggcctttcaccaggggccagaaatgctcccacaaccctcaatggtctcactacaacagttccgaatcttattccaaatgctatagtatctgaaacggttcaccaatagggataatgtttctccaactggagaccttcaataaaacacttcaataggtgctttaa

SEQ ID NO: 6332 - DNA, 3779 bp, Homo sapiens
cagtttgagttattaacacgaggaaaataaaacacatatccatataaagaaatgaattcaagtatttacagcagctttatttgtaatatacaaaaatctataaataatataaatgtccctaaacacatggataaacactgacttatccatagaacagcatgatactcagcaatacaaagattcatcatttttgaatctcaaaataattatacagcatgaagaaaaccagtaagtatatatatatacacacacacatatataaacacatatgtatatatatacgtatacgtatatgcgtatacgtgtgtgtgtgtgtgtgtgtgtgtgtgtgtatgtatctcagtaaaaactccagaaaatgcaaactaatttactgtaaaggaaatcagttgaacctgaagagctggggaagggagaaagattataaaaagatacaaggtaaatatatgggtgacacacaaattcatttttatggttgtaatgatggtttcatggctttaccaaactgtacactttggatacgtgtactttgttgcatgtcagttatacaaattagaccttcaaaaagctttaaaaagtggctcaaaattaagagcctagatgttcctttttttttaatcagggtggcaacctgatatggacttcaccatctctctctctcctcatgccctgagagaggcaaccttgcctcaggggcagcaaattttggcaagcaatgaaggctgttgccacctgaattaataggaatgttggctgagtcacaaaagccacatccctggaccgcggaatgatccttctctctattcttgttctcctacctgcatagcaatggccttgaggtgaacagcccagacaggatacaaggagccacaaaacctttatagactattttcttttttttttttggagacggagtctcactctgttgcctgggctggagtgcagtggtgcaatctcagctcactgcaacttccgccttctgggttcaagcgattctcctgcctcagcctcccaagtggctgggactataggcgcatgctgccacgcctggctaattttttgtattttagtagacatgggatttcaccatgttgcccaggctggtcttgaactcctgagctcaggcaatccgcccgccttggcctcccaaagtgttaggattacaccatgcccggccagactattttctgataatgatctcagcgatagtaaacagaagatcctgagaatttctgtatgcactgatcctacacaaccatattcactggaaaatttgtagatgaacttttagaagagtcattccatctaatttactgcagtcttctccactccccatttacctggagtttctgtcccaattactgttgaacctgtaatttcacctccacacctatagtctgacaacaaatggcaccagtctacactgacttatatgccatggcacctggctcctttgcaggacctgggcaacagattcccctcaccagtgctaggaattatgtggatctcctgtggacaactgaacaaaattcacgttcacagaagcactggggattgtcacaactgcctccttttcatggtgacctctgacctgacaaaaatggcaccaggccacaatacaggaacacaaagcctggcagtctttactttgaggccttgggcagcaggccaattagagcaatacagaacaaagagctgtcttctgccatcacattgtcccttctgagtacagaaagtttgagatctccacaaaatctattcaccccttcatgctgacatcactattctgcttacaagtcattctatgcaatgaatagaacacccaagattaaaggtgcgtaaatttttttaaaacctttataaaaacattataaattaaagcaatgtgcaccaagcagtttccaggctggtgaatcagaatgtggaaaaattcattacaagcatcatgtgagaccgacaatgttccttaaaaaagtaatccttagaaagctgacagcacaactcagattctctggaccacaactgggtcaggtgtatactctaaagtcagagaaaagacatgaagaccctacatgcttgggctattaataatttccccaagcaaatgggagagtacagaggtttgcttctctgagcactgtggggaagtgactcatgcacatggtgtgcacctgccaggtggtaggggtgaaatgtgaaatggcttcagcctcagaaattggcagtgacataaatcaggctataggcctcggcagattagaaattacaatgaacctcctcagagcttcccacatacctgaaacttatgaagaataccccactgtgggtgctcaaagtttaaatttacgaagatggctaccacagtctcctccagtgctattatactgaataaagaaatagcacattcccttcacatttaaggcctttcttcagtgtgaactctccgatgtcgaatgaggttagatttgcggctaaaggatttcccacattcactgcattcataaggcctttctccagtgtgaactctttggtgctgaataaggtctgatttgtgggtaaagggtttcccacattgactgcactcataaggtctttctccagtgtgacctctctggtgttgaatgaggctagagctctggctaaaggatttcccacattcactacattcataaggcctttctccagtgtgaactctctggtgttgaatgaggctagcactttggctaaaagactttccacattcactacattcataaggcctttctccagtatgaagtctccggtgctgaatgaggccagagcgctgtctaaaagatttgccacattcactgcactcataaggtcttgtgccagtatgaattctccggtgttgaatgaggtcagatttgcgggtaaaggattttccacattcactgcattcataaggtctttctccagtgtgaactctttggtgttgaatcaggataaatttgcggctaaaggatttctcacattcactgcactcataaggcctatcaccagtgtgaatgctgcggtgtcgaatgaggttagagaattgtctaaaggatttcccacattctctgcattcataaggtctttctccactgtgaattctctggtgttgaatgagttccgatttgcagctaaaagatttcccacaatcactgcactgataaggcatttctccagtgtgaactcttctatgtcgaatgagattgaagatttgtctaaaggatttcccacactcacagcactgataaggcctttctccagagtgaactctctggtgtcgaaaaaggctagagctttgtctaaaggatttcccgcactcgccacattcataaggcctttctccagtgtgaactctctggtgttcaatgaggttagatttgtagctaaaggttttcctacattcaccacactcatgacgcactcctccagtgtgacgtctctggtggtgaatgaattcagatttatggataaaggctttctcacgatcactgcattcataaggcctttctccagtgtgaattatcttgtgtaagattaggtggcactttttgctaaaggattcctcacattcactacactcaaacatcttttgtccagtgtgaatttgctggtgctgaacaagtgtgttcttgcaagtgaaggctttctcacatttgctacactcataaagccctccttcagaacagacactctgatgctgaacaagtgtgtgtttgtggcttgaagcttttctgtattcaccccacttgtaataactttttgcattg

SEQ ID NO: 6333 - DNA, 669 bp, Homo sapiens
aaaccctatgcgtgtaatgaatgtgtgaaatccttttgtgtgaagtcaagtctcattatacaccagagaactcacactggagagaaaccttacaaatgtaatgagtatggaaaaacttttcaccataaatcaaccctaacagtacatcagagaactcatggggagaagccttataaatgtaatgaatgtagaaaatctttctatatgaagtcagccctcagtcagcatcagaggatacatatatgggaggaacattgtgaatgtaaagaatgtgggaaaacctaccagaggtcacaccttgctaaacatcatcgaaaatacaccaagaaaccctatgaatgtaagcaatgtggaaaaaccttccagaagtcacacctcattgaacatcagaggacacacccaggggagataccccatgaatgtaataaatgtgggaaatccttctgttataagtcacccttgaccattcaccagagaactcacatagaagagaagccctataaatgtagcaaatctgttacttatttctgtatgaaatcacacctcactgtgcatcagagaccccataccaggaagaacccttttgagtgtaatgaatgcaggaaaatgttttatgtgaagtcaaacctcatcaatcatcagagaactcacacaggggagaaaccatat

SEQ ID NO: 6334 - DNA, 1529 bp, Homo sapiens
gggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaaggttggtatatttgtcttttttt

SEQ ID NO: 6335 - DNA, 5116 bp, Homo sapiens
ttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgttaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctg

SEQ ID NO: 6336 - DNA, 1258 bp, Homo sapiens
atctcggggttcagactctctgacctgaggtaggctccccaggggctgggagaggggtttgacggaatggaggatggaggacagcgggaagaagaaacgaggaggaatgcaacgtgtggggcggccgccaagagtgaaaatagagggaagcgccatgcaagtgctggaaagaagggggcaggtgggacgagccccacagccccctccacaaaaagaccacttccgggactcagtgctcctttgggggcaggctccgccagctctccgccactcagggctccggtcccacggtcggagtgcccgggacggagacggccagttctggcggccaggtccgacgctctagaatccagccccatttccctcccggccacgcccgtccggcggcctctcctgtcatattcagcccctactcacctggggaccccgggaggggcgcgagggcacctgcagggggagggcctaaggggtcaggggaagcccccggtgtggagggtacgacgggcgcttcccccagggtggacgcagcaggcagaggcccaggagcagggctccgcaacccgggccgggctgggggcacggcggggagtcggcactgcgtcgtggggctggacttgggcgacctgcgggcgaaagggagccaggaacagaaagaggagcgatgagcggccccgcccaccctaaggccccgccccagcccagtgccagccactcccatgcatgcaagccccttcctgaaggcccgaggcggtcaccggagcttaagccccgccgccagcggcgccaacctcccagatccaccccgccccgcagcccgcgctccacggcaagccccgccctctctaagctccgcctctcgcttcaagtaggcgccaccccgggatgggggcgcgccctgcctggtccggcacttcttccgcggcccaggctggggggctttggggccgtgggggccgaccctggtacctgcgtccgaccgggacgctctgcacctgcagccaggagtcatccacaggaccccgtgggtgtgctgacgatggtcgtcttgatgtcaccgatgatgctgggcgcctccctcagcacgtggtgcatgcgccgcatctcgttgcgcccctgtgcctgctctgccgactcccccatcagcgtgttctgttccccacgcgagtacaagttggccagcagctccgagaagatgaactccttggtctgagagcgggcaaagagggaaggagactgggacctgattgatgcttgtgct

SEQ ID NO: 6337 - DNA, 1798 bp, Homo sapiens
aggcgcgacgccccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatgtcaatcttcaagaagtatcaagtccatccaggcgcggtggcttacacctgtaatcccaggctttgggaggccgaggcagccggatcatgaggtttggtgcctggaatgctgacctagatctggaaactagcccagatgaaagcaagaatgatgaggccacagtgtccatgaaagtagggtgaggagggtgtccagtggagccagagggagtgccaagagggaggtccttggaacac

SEQ ID NO: 6338 - DNA, 2338 bp, Homo sapiens
cttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcttgctccggaggtccgaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacagatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaa

SEQ ID NO: 6339 - DNA, 1504 bp, Homo sapiens
agaattgctggccttctgacaagctagctgtttggatattgtgagggatgaggttgctgcagcaaaaagtgggttacacgacagcacagcctcgctgctggagatgaaaaaccaataatcccagaaaacagcgcatagggtaggctgggccagccgaggattatgtgaaggttcgttgggaccctccggaggccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacaga

SEQ ID NO: 6340 - DNA, 2183 bp, Homo sapiens
gcaatatttggttcctattctttgacaaggataagctattgagaccaatcagaaccttccaatgtgtttccaatgttcttggctacatttctacttaaactcaaacctcaggaagaatataatctgttaagataacttttgtttttctcaaacattctctctctgcctatcccaaaagaatcaatcaatgctttatgttactaagttcactgattatgaggacaatgtctgaagatttcatacacataatattgggatcttccctttccttgaatttcagaatatgttggagccaatttctataaccaaaacgtagtatttgtgtatctttaaatgagctacaatccagaactgaaaatgaactatactaatggcatcgcacttaacaactttcaatgaagaaagaaataggttagagtctaagttcaaacacacttcaaactcacgtgaccacagtaaatcctacccttaaagcaagtacatatgtgtgtattgtttatgtttcttattttctgtatattatgatggttttgactcctttctggctgggaagagattgcccctctaggggccagccaacgcttagagaaggcaaaggactcagcgtgcctttcacatgcaaactaaacaatccacagcgatacctcctctacctgacccatacacccaggaggcaatattcccctgcctggtatctaccaggcaaactagggatcactcttacagtttagagcctgtatacctataacttattcaaagctactattattacacacctatagcttattagtagtagtagcagtagcatttacctacagctaatgcaaactagcgaatcctaaacttggttacccgccctgccttgcctttcccacagatactccagaaacggctgcagcccggtctctcttctagctcctgcccctttggcccctagaccaacactggggctttctcatgtggccctgaatggcatgctgtgcctccgagaactcatgagtataataaactttgttttcctgagcccctcctgggtctccttttcacatgcacctgactgaccacataaaagaacacagaactctgtgtgtgtgtgcgcgtgtgtgtgtcattttcattttattttcccttgttcaggtggtcaataaaaaattattacacctttaaaaagaggtacctaaataaacaaacctaccaattctgtatgcaaaattaaatcctggactggcagtgttgctcagataacactcagaaaagaacaatgtgactgaaactgtaaggaacaggtcaaaaacactccatttaaaatgtgaacacctgctacagaatattttgattcacaagtccatctaggaaatatttttcttcctccctcacctgttcccccacctatcttgcattcaacaccataaacagcacttatcccccattataaaacagttgacggttaaaacaatgagccaaccaagaaagtataatactctataactgacatttactgcattggccttggacttctaatctttaccagacgggcacacaaatcaatccatcagctcataaaggtgtgcttttttaacctctaaaacagatgggattggccagaagtgtctggcatgtcaaactgctaatcactgctgccctttgcacaaaataacccacttaagttgaggcatggttgcactgtaaccgacattagtctgtgggaaacccatttaactgtcacacactcctgccactcctgctctcccttaattaagcctaatgccttatgctttgaccttttgttctagcctattaaccctatctagtacaagttcaattatgttaagctaaaaactttgctgtaaaatattaaatgccaagctcaaaaaatcataagggacatcctctcagccctaagttctattcaccctgatactcaatacatttgaaagtaaaacctcactttcgaagtaacgctgatactgaagcaaggagatgttgaatgactcacccatttcatagcttttccgtggcaaagcctcactaaaacctatctaatccctagctccaattctttaatctccatggtgcttctgattaatagttaaaccacccggaagtatgttaaggatactaacattttcaccccgaagtattatccttcgccatcctctagaatatgctatgcaaagaggcct

SEQ ID NO: 6341 - DNA, 1170 bp, Homo sapiens
tgtgagaagtcaaccttcttcaaacatcagaaaagaactcacacagtagagaaaacttttgaatgtagtcatggcaagaaatctttttgccaggagtcccacttcactgagcatcacaggacatgcacaagagagaaaccatgtgaaagtaataaatatgggaaaaccttccatcagaaaagaagctttattcatcatcagagaactcacacaggggagaaaccatatgaatgtaaggaatgtaggaaatccttccatgtgaaaccaaacctcactaaacatcagaaaacacatataggggagaaacctttcaaatgtactgcgtgtggaagaactttcttccagcagtcaaccctaaatgtccatcagggaaagcacacagaagagaaaccctataaatatactgagtgtgagaaatccttctataaatcagtgctaattatacatgagagaactcacactggggagaaaccctgtggatgcaatgaatgtgagaagtccttcgaagtccttacaaccctagttatacaccagagaactcacactggagagaaaccttacaaatgtaatgagtgtgaaaaatcctatctgaacctgaagtcacatcttaatattcatctgagaaatcacacaggaaagagaccccatgtatgtaatgaatgtgggaaggccttttctatgaagtcaaacttcactgatcatcagagaacacactgtggggagaagccttataaatgtaatgaatgtagaaaatctttctatatgaagtcagccctcagtcagcatcagaggatacatatatacaagaaaccctatgaatgtaagcaatgtggaaaaaccttccagaagtcacacctcattgaacatcagaggacacacccaggggagataccccatgaatgtaataaatgtgggaaatccttctgttataagtcacccttgaccattcaccagagaactcacatagaagagaagccctataaatgtagcaaatctgttacttatttctgtatgaaatcacacctcactgtgcatcagagaccccataccaggaagaacccttttgagtgtaatgaatgcaggaaaatgttttatgtgaagtcaaacctcatcaatcatcagagaactcacacaggggagaaaccatatgaaggcaatacatgtgggaaa

SEQ ID NO: 6342 - DNA, 6856 bp, Homo sapiens
atgagtcagccaggtccaccgccagcccaggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctca

SEQ ID NO: 6343 - DNA, 3471 bp, Homo sapiens
gaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagtctccgctggttcatcctccaagccatggatgccgctcgactcacaacagcccaattcacactgctactggctcacgacttactcagaacttctctgtgtctgttcccactctcatctatactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgcctttgtcggaattatgggtaacacaagatcttacaaactgctagactggaatagtttcaattcagatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataag

SEQ ID NO: 6344 - DNA, 2881 bp, Homo sapiens
aattcccagcgtgacccggaggcagcccgggcagaagggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagagagtggagaaagcctcagagtttgcagtgtcaaatgcattttttactagaaattcagatttacctagaagtccctggggccaaatcacagatttgaaaacatctgagcaaatagaggatcatgatgaaatctatgcagaaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatgtagagctctcaagattgtttagattgaagttctcaaggttgtttagattgaaatcttttagatttggcagtgaaggactctttagtgacttgggtgagggcaattcttgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaaggcagggctgtctcggtggtggccttggtggttgttatcttctctcctagagtagaatgtgtacactgggactgaattctggcaactcttgaggttttgagacttggcagaacctgacatcaaaaatctcagaatggtagacatgtgaggagtggagtacaccagagagccccactacttttttcctgccccttttgccaacctttttggcattcccagccaacacacacacaaaaaaacatagctgaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaaga

SEQ ID NO: 6345 - DNA, 2488 bp, Homo sapiens
agtggtgctgtcagcgcggccgtcggagacatgggagacccggggtcggaaataatagaatctgtccctccagctggccctgaggcatctgagtcaacaacggatgaaaatgaagacgacattcagtttgtcagtattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtcttttttttttttggaaagccagttaaacttttatcagcatgttgctgtttaaaaggcgttctttaagaagataatcttgaagattggttttagaagctatagtttttta

SEQ ID NO: 6346 - DNA, 1876 bp, Homo sapiens
cattccatgcagacaagcgtgtccttcatgagacaggattcagtactgagctagatcgtgtaaagaatctgcctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctgatggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcacgggacacccttgtcaggaaagtcagccaatgccgttagcgtggccaagtactacaacgcagcctgcctgagcatcgactccattgtgctggaagctgtggccaacagcaacaacatcccagggatccgggcctgtgagctctgcatcagggctgccatagagcagtccatgaaggaaggagaggaggctgctgagtgactgctaccgaggagtggtgtttgatggcctcgacactctctttgctcggaatgctgcagccgccctcctctgcctgctgaaggccattggcagccgggagcatatatacattctcaacatggcccaggattacgcagccatgaaggcccgggagaaagccaaaaaggagcaagaaggcaaggcctcctacctttccattgggcttaagtgaaactttgacatttgctattccgttggcgcctcacctctgccctgtaaggtggccaggagttgtatttctgctttgctaggagggaactgggacgcgagtggctggctgggaagttctatgatgaacgctttgctgacagcaggtgcattcctgcttccctcccatcacactgtacccctccatcctttctgcaattacagccattttgggtccc

SEQ ID NO: 6347 - DNA, 1538 bp, Homo sapiens
atcaacgcccagctgcctcgggagcagcggcaccgctggtgcctgctcttttcgtctgagctccatggacacagcttctcccagctctgtggccacatcactcaccggggaccctgtgtggctgtcctcgaggaccatgacaagcatgtgttcggtgggtttgcctcttgctcttgggaggtgaagcctcagtttcaaggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaacgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttctttttttccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaat

SEQ ID NO: 6348 - DNA, 3210 bp, Homo sapiens
agtgctaggcagaagcaacagccatcgccttggtgcaggggtatcctgagatctgaagcaaatgtcctcacagttattgatgagctcataagtgctgggcactgtggcctgggggattgtttgttcagcaggctctgtctcagatatgggtattacagagtccagtgatacgccaagttctctaagtcctctgaatctccctggagctggaagtgagatggaagagaaggttgctcccgttaaaccgtctcggccaaaaaggcacttctcttctgctggcaccatcgaaagtgtcaacttagatgccatccccctggccatcgctcgcctggacaacagtgccgccaagcacaagctggctgttaagccaaaaaaacagagggtgtcaaagaagcacaggcgccttgcccaggatccacaacatgagcaaggcggccttgagagtcggccctgcctggaccagaacggacacccaggcgaggacaagccaacgtggcacgaagaggaacccaatccgctggattccgaggaagagagaagacgccaagaagactactggcgagaactggaggccaagtgcaagcggcaaaaggcggaagcagccgagaagagacgcctagaggagcagaggctgcaggcgctggagaggaggctttgggaagagaacagaaggcaggagctcttggaggaggagggcgaggggcaggagccgcctctagaggcggaaagggcgccgcgggaagagcagcagcggagcctggaagcgccaggttgggaggacgcggagcggagggagcgtgaggagcgcgagcgcctggaggcggaggaggagcgaaggcgtctgcaggcccaggcccaagcggaggagaggcggcggctggaggaggacgccaggctggaggagcggaggcggcaggaggaggaggaaggaagatgcgcggaggagctcaaaaggcaggaggaggaggaggctgagggatgggaagagctggaacagcaggaggcggaggtgcaggggccgcccgaggcgttggaggagactggggagggccggcggggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagccccgccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccgggcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcct

SEQ ID NO: 6349 - DNA, 306 bp, Homo sapiens
gtcttgctctgttgcccaggctggagtgcagtggtgcgatcttggctcactgcaacctccgcctcctggcaattagctgggattacaggcatgtgccaccacgcccagctaatttttgtattttttatagagacggagtttcaccatgttggccaggctggtcctgaactcctgacctcaggtgatccttctgcctcggcctcccaaagtgctgggattacaggtgcgagccaccccaggcgtgctaatttttgtatttttggtagagatggggtttcaccatgttggccaggctggtcttcaact

SEQ ID NO: 6350 - DNA, 393 bp, Homo sapiens
agtgcctgtatgtgtgtatgtgtgtgtgtatgtatgtatatatatatatatatatatatatttttttttttttttttttttttttttttgaatatttttaagcaggcaccaccacgccagaatcaggttaggcggccaggcgcagtggctcacacttgtaatcccagcactgtgggaggccatggcgggcagatcacgagaggtcaggagtttgagaccagcctggccaacatgggtgaaaccccatctctactaaaaatacaaacctggccgggcgtggtagcacacgcctgtaatcccagctactcaggagggaggctgaggcaggaaaattgcttgaacctgggaggcggaggttgcggtgagatcgcactccagcctggacaacaagaa

SEQ ID NO: 6351 - DNA, 309 bp, Homo sapiens
gaggtgggaagatggcttgagccagggaagcaaaggttgcagtgtgctgagatggcgccactgcactccagcctgggtgataaagccagaccttgcctcacaaaaaaaaaaaaaatgcttgatatgaaccctaccttagtgtgttatagacagggtcttgctttgttgcccaggctggggtgcagtggtgccatcttggctcactgtaacctccgcctactgggttcaagcgattctcctgcctcagcctcccgagtagctgggattacaggtgcccgccaccacgcccagctaatttttgtattttaa

SEQ ID NO: 6352 - DNA, 285 bp, Homo sapiens
ttttttttttttttgagatggagtcttgctctgctgcccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtcttactatgttgcccaggctggtctccaactcctgggctgaagcgatcctcctgccttggcttccgaaagtgctgggattataggcatgaacca

SEQ ID NO: 6353 - DNA, 342 bp, Homo sapiens
tggtgcacgcctttaatcccagctactgaagttgagacaggaagatgggttgagcctaggagttcaaggcttggtttttttttagtagagcttttgtcatttgacctgggcaatagagcaagactccatctcaaaaaaaaaaaaaaaaaaaaatccctgggtaagatttatttttttttgagatggagtctcgcactgttgcccaggctggggtgcagtggtgcgatctcagctcactgcaagctccacctcctgggttcacaccattctcctgcctcagcctcccgagtagctgggattacaggcgcccgccaccacacccggctaatttttttttttttg

SEQ ID NO: 6354 - DNA, 393 bp, Homo sapiens
agtgcctgtatgtgtgtatgtgtgtgtgtatgtatatatatatatatatatatatatatattttttttttttttttttgaatttttaactaaattaataaaacagctggtgatgattaagaatcaggttaggcggccaggcgcagtggctcacacttgtaatgccagcactgtgggaggccatggcgggcagatcacgagaggtcaggagtttgagaccagcctggccaacatgggtgaaaccccatctctactaaaaatacaaacctggccgggcgtggtagcacacgcctgtaatcccagctactcaggagggaggctgaggcaggaaaattgcttgaacctgggaggcggaggttgcggtgagatcgcactccagcctggacaacaagaa

SEQ ID NO: 6355 - DNA, 381 bp, Homo sapiens
atcttggctcactgcaacctccacctcccaaattcaagtgattctcctgcctcagcctcccaagtagctgggattacaggcacatgctaccacacccagctaatttttgtatttttagtagagacagggtttcaccatgttggtcaggatggtcttgaactcctgacctcaggtgatctacccgcctcagcctcccaaagtgctgggattacaggtgtgacccactgtgcccagccttcctcactactcacttcagaaggaaggaaggaaactgtaagtacattttttttttttttcttacatgagacagtgtctcattctgtggcccaggccagagtgcagtggcacaatctcagctcactgcagcctccgccttctagg

SEQ ID NO: 6356 - DNA, 285 bp, Homo sapiens; identical to SEQ ID NO: 6352

SEQ ID NO: 6357 - DNA, 96 bp, Homo sapiens
gcaaaaccccgtctccaccaacctggccaaagtggtgaaaccccatctctattaaaaatacaaaaattagccaggcgtggtggtgtgcacctgtaa

SEQ ID NO: 6358 - DNA, 261 bp, Homo sapiens
tctgtcgcccaggctggagtgcagtggcacaatctcggctcactgcaacctccacctcccagattcaaccgattctcctgcctcagcatcccgagtagctgggattataggcactcgccaccactcctggctgatttttgtatttatttagtagagacggggtttcaccatgttggccaggctggtctcgaactcctgacctcaagtgatctgcccacctcagcctcccaaagtgctaggattacaggcgtgagccaccgc

SEQ ID NO: 6359 - DNA, 195 bp, Homo sapiens
cccaggaggtggagcttgcaggtgtacccaacagctccgaagagacagcgaccatcgagaatgggccatgatgacaatggcagttttgtggaaaagaaaagggggaaatgtggggaaaagaaagagagatcagattgttactatgtctgtgtagaaagaagtagacacaggagactccattttgttctgtactga

SEQ ID NO: 6360 - DNA, 453 bp, Homo sapiens
aggttctatattggctgtgatctttgtactaactgctattatggagaatgtgttggcatcgcagaaaaggaggctaagaaaatggatgtgtacatctgtaatgattgtaaatgggcacaagagggcagcagtgaggaattgtactgtatctgcagaacacctgcaggatcttgcagattttttattggccatgatcggtgtcagaattggtaccatgggtgctgcattggcatcttgcagagtgaggcagagctcattgatgagtatgtctgtccacagtgccagtcaacagaggatgccatggcagtgctcacaccactaacagagaaggatgatgaggagttgaagagggtgctctgttccttacagacccataagatggcccagcctttccttgaaccagtagaccctaatgatgcaccagattattatggtgttattaaggaacctatg

SEQ ID NO: 6361 - DNA, 411 bp, Homo sapiens
ggcacaatctcggctcactgcaacctctgcctcctggattcaagtgattctcctgcctcagcctcccgagtagctgggattataggtgcgcaccatcacgcccagctaatttttgtatttttagtagagatggggtttcaccatgttggtcaggctggtctcaaactcctgacctcggatccgcctgcctcggcctcacaaagtgctgggattacaggtgtgagccaccacaactggcttcatgggggtcctgacagagtcaagagaccgcccgttttttttttttggttttttttttttgagatggagtcttactctgtcgcccaggctggagtgcagtggcgtgatctcagctcactgcaacctccgcctcccaggcacaccattctcctgcctcagcctcccgagtag

SEQ ID NO: 6362 - DNA, 279 bp, Homo sapiens
ctcacccccgacggcttcttcttccgagtccacatgttagtcctggactcctccagctgcaataaaccgtgtccagagtttaaacctggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcgattcatacccaatgcatttga

SEQ ID NO: 6363 - DNA, 375 bp, Homo sapiens
tcttttttcttttttttgagacagagtctctctctgtcggccaggctggagtgcagtggcacgatctcggctcactgcaagctccgcctcctgggttcacaccattctcctgcctcagtctcccgaatcacgaggtcaggagttcaagaccagcgtggccaacatagtgaaactctgtctctactaaaaatacagaaattagccgggcatggtggcaggcacctgcagtcccagctacttgggagggtgaggcaggagaatcgcttgaacccgggaggcaaaggttgcagtgagccgagaccatgccattgtacctcagcctggactacgtctcgaaaaataaagaaaaagaaaagaaaaagaaaaaaaaagaaa

SEQ ID NO: 6364 - DNA, 396 bp, Homo sapiens
tgtatgtgtgtatgtgtgtgtgtatgtatatatatatatatatatatatatatatcccagccaatttatatctttttattattattattattattatttttgagacagagtctgatgattaagaatcaggttaggcggccaggcgcagtggctcacacttgtaatcccagcactgtgggaggccatggcgggcagatcacgagaggtcaggagtttgagaccagcctggccaacatgggtgaaaccccatctctactaaaaatacaaacctggccgggcgtggtagcacacgcctgtaatcccagctactcaggagggaggctgaggcaggaaaattgcttgaacctgggaggcggaggttgcggtgagatcgcactccagcctggacaacaagaa

SEQ ID NO: 6365 - DNA, 111 bp, Homo sapiens
gggagggatgactggcaagcagctccacctgcggccccagtgcgggatccactgggtgaagccagctgggctcctgagtgtggtggggacttggagaacctttatgtctag

SEQ ID NO: 6366 - DNA, 318 bp, Homo sapiens
tttttcctttcctttttgcatagtttttttttgagacagagttttgctcttgttgcccaggctggagtgcaatggcacaatctcggctcactgcaacctccacctcccgggttcaagcaattctcctgcctcagcctcctgagtagctgggattacaggcatgtgccaccatgcccggctaattttgtatttttagtagagatggggtttctccatgttggtcaggctggtctcgaactccgaacctcaggtgatccgcccaccttggcctcccaaagtgctgggattacaggcgtgagccaccgtgcccagcccagt

SEQ ID NO: 6367 - DNA, 276 bp, Homo sapiens
ttttttttgagatggagtctcactctgtcgtccaggctggagtgcagtggtgcgacctcggctcactgcaacgtccgcctcccgggttcacgccattctcctacctcagcctcccgagtagctgggactacaggcgcccgccacctctcccggctaatttttatttttagtagagacggggtttcaccgtggtctcgatctcctgacctcgcgatccgcccacctcggcctcccaaaaagctgggattacaggcgcccgccaccatgcccggctaa

SEQ ID NO: 6368 - DNA, 378 bp, Homo sapiens
cgccaccaagcccagctaatttttttgtatgatttgtttttgtatgtatattttttaaaagacagagtcttgctctgtcacccgggctggagtgcaatgacgcgatctcggctcactgcaacctctgcctcccaggtagctgggactataggcatgtgccaccacgcccggctgatttttttttttttttttgtatttttagtagagacggggtttcactgtgttagccagcatggtcttgagctcctgaccttggatccccctgcctcggcctcccaaagtgctaggattataggcctaaaccactgcacccagcctacattttgtatttttagtagagatggggattcaccatgttggccagactggtctcgaact

SEQ ID NO: 6369 - DNA, 324 bp, Homo sapiens
caaataaaaagcaaattttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttatttttaatagagacagggtttcactatgttggtcaggctggtctcgaactcctgacctcaggtgatctgcccacttcagcatcccaaagtgctgggattacaggcgtgagccactgcacccagccggaagacatattc

SEQ ID NO: 6370 - DNA, 366 bp, Homo sapiens
tgggattacagttttttcttttttttgagacagtctcactctgtcccccaggctggagtgcagtggtgcaatctcagctcactgcaacctccgccttccaggttcaagcgattctcctgtctcagcctcctcagtagctgggattacaggcacacaccaccatgcccggctaatttttgtatttttagaactttttttttctttttgagatggagttttgctctgtcacccaggttggagtgcagtggtgcaatcttggttcactgcaacctctgcctcccgggttcaagtgattcttgcctcagcctccccattagctgggactacaggtgtgcaccaccatgcctggctaatttttgtattttt

SEQ ID NO: 6371 - DNA, 369 bp, Homo sapiens
tgggattacagttttttcttttttttgagacagtctcactctgtcccccaggctggagtgcagtggtgcaatctcagctcactgcaacctccgccttccaggttcaagcgattctcctgtctcagcctcctcagtagctgggattacaggcacacaccaccatgcccggctaattttctttatacatttgaacttttttttttctttttgagatggagttttgctctgtcacccaggttggagtgcagtggtgcaatcttggttcactgcaacctctgcctcccgggttcaagtgattcttgcctcagcctccccattagctgggactacaggtgtgcaccaccatgcctggctaatttttgtattttt

SEQ ID NO: 6372 - DNA, 369 bp, Homo sapiens; identical to SEQ ID NO: 6371

SEQ ID NO: 6373 - DNA, 81 bp, Homo sapiens
ttcctaatggataagtcgagcctgaccggggcactctgctccatcaccctggcttctccctgtggcactccaggcatatag

SEQ ID NO: 6374 - DNA, 315 bp, Homo sapiens
gagacaggaagatgggttgagcctaggagttcaaggcttggtttttttttagtagagcttttgtcatttgacctgggcaatagagcaagactccatctcaaaaaaaaaaaaaaaaaaaaaatccctggtaagcattgtgtctgttttatgagatggagtctcgcactgttgcccaggctggggtgcagtggtgcgatctcagctcactgcaagctccacctcctgggttcacaccattctcctgcctcagcctcccgagtagctgggattacaggcgcccgccaccacacccggctaattttttttttttttgta

SEQ ID NO: 6375 - DNA, 225 bp, Homo sapiens
tgcttttcacactcttttttttttttttttttttttttgagatggagtctcgctctgtcgcccaggctggagtgcagtggcgcaatctcggctcactgcaaactccgcctcctgggttcacgccattctcctgcctcagcctcccgagtagctgggactacaggcgcctgccaccatgcccggctatttttttgtatttttagtagagacggggtttcaccgtgt

SEQ ID NO: 6376 - DNA, 321 bp, Homo sapiens
gtgctcaatggtgcccaggctggagtgcagtggcgtgatctcggctcgctacaacctccacctcccagccacctgcctaggccttccaaagtgccgagagtgcagcctctgcccggccgccaccccgtctgggaagtgaggggcgtctctgcctggccgcccatcgtctgggatgtgaggagcccctctgcctggctgcccagtctggaaagtgaggagcgtctctgcccggccgccatcccatctaggaagtggggagcgcctgtgccccgccgccccatctgggatgtaaggagcgtctctgcccagccgccccgtctg

SEQ ID NO: 6377 - DNA, 285 bp, Homo sapiens; identical to SEQ ID NO: 6352

SEQ ID NO: 6378 - DNA, 396 bp, Homo sapiens
tgtatgtgtgtatgtgtgtgtgtatgtatgtatatatatatatatatatatatatcccagccaatttatatctttttattattattattattattatttttgagacagagtctgatgattaagaatcaggttaggcggccaggcgcagtggctcacacttgtaatcccagcactgtgggaggccatggcgggcagatcacgagaggtcaggagtttgagaccagcctggccaacatgggtgaaaccccatctctactaaaaatacaaacctggccgggcgtggtagcacacgcctgtaatcccagctactcaggagggaggctgaggcaggaaaattgcttgaacctgggaggcggaggttgcggtgagatcgcactccagcctggacaacaagaa

SEQ ID NO: 6379 - DNA, 279 bp, Homo sapiens
tctgtcgcccaggctggagtgcagtggcacaatctcggctcactgcaacctccacctcccagattcaaccgattctcctgcctcagcatcccgagtagctgggattataggcactcgccaccacgcctggctgattttttatttctagtagaaacagagttttgccatgttggccaggctgccctcgaactcctgacctcaggtgatctgcccacctcagcctcccaaagtgctaggattacaggtgtgagccaccgcacccggcccagtttattttac

SEQ ID NO: 6380 - DNA, 420 bp, Homo sapiens
ggcacaatctcggctcactgcaacctctgcctcctggattcaagtgattctcctgcctcagcctcccgagtagctgggattataggtgcgcaccatcacgcccagctaatttttgtatttttagtagagatggggtttcaccatgttggtcaggctggtctcaaactcctgacctcggatccgcctgtctcggcctcacaaagtgctgggattacaggtgtgagccaccacagagagcctcaacaccctttccttctatctgttgagtcaagagaccgcccgttttttttttttggtttttttttttttgagatggagtcttactctgtcgcccaggctggagtgcagtggcgtgatctcagctcactgcaacctccgcctcccagggctcaagccatcctcccacctcagcctcccaaa

SEQ ID NO: 6381 - DNA, 396 bp, Homo sapiens
tgcaacctctgtctcctgggttcaagcgattctcctgcctcagcctcccaaatagctgggattacaggcgcacatcaccacacctggctattttctgtatttttggtagagtcagggtttcaccatgttggccaggctggtcttgaactcctgacctcaggtgatcctgcctcagcctcccacagtgctgggattacaggcgtgagccactgtgcctggcctagattagaggccacatctgtcccaaatttcttttttttttttttttttttttttttttttttgagacggagtctcgctgtcgcccaggctggagtgcagtggcgcaatctcggctcactgcaggctccgcctcctggggttcacgccattctcctgcctcagcctcccgagtag

SEQ ID NO: 6382 - DNA, 150 bp, Homo sapiens
ccttcctttcttctgtttttccttccttccttccttcctttctctctctcctccctttccttccttcctttccttctttcttttttgactgggtctcacttattttccatcacacacacacacacacacacacacacacacacacacaca

SEQ ID NO: 6383 - DNA, 420 bp, Homo sapiens; identical to SEQ ID NO: 6380

SEQ ID NO: 6384 - DNA, 396 bp, Homo sapiens; identical to SEQ ID NO: 6381

SEQ ID NO: 6385 - DNA, 279 bp, Homo sapiens
ttttttttttttttttttgagacagattgtcgctctgtcaccaggctggagtgcagtggcataatctctgctcactgcaaactctgcctcccaggttcaagcgattctcctgcctcagcctcccaagcagctaggactataggtacatgccaccacacccagctaatttttgtattttttgtagagacagggtttcaccatgttggccaggatggtctcaatctctcactggtgatccacccacctcggcctcccaaagtgctgggattacaggtgtga

SEQ ID NO: 6386 - DNA, 225 bp, Homo sapiens; identical to SEQ ID NO: 6375

SEQ ID NO: 6387 - DNA, 470 bp, Homo sapiens
gccaggaggcgcggccgccgccgcctcagtcatggctcctcgccgtagccgatgtttttgtacctccatctgcggaggccgcggcgcccggccccagctgccccggacgtgcggcgacggcacgcagcactgcggcagggggaagccagccctcgctgcggccgaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagtctgaagatgccaccaacatcaaagggaatggagagttggtccttggtgatagcattaagccactgtatcaaccaatcctgacaatttgtatgacttctggatttccagccacattacaacaatgtaacaataaacatttattaattgc

SEQ ID NO: 6388 - DNA, 369 bp, Homo sapiens
gtgtgtgtgtgtgtgtgtgtgtgtgtgtgtgtgtgtttatttatttacttttcagttttttggagttttctttatttgtttgtgtttttgttaaaaatatatgaaaagaggccctgcgcggtggctcacgcctgtaatcccccaggcgtggtggctcatgcctgtaatcccagcactttgggaggccgaggcgggcagatcagctggagtcaggagtttgagaccagcctggccaatatgagcaagactccgtctcggaaaaaaagaaaaggctggagtggcgtggtggcgcatgcctgtaatcacagctactcgggactgaggcaggagaattgcttgaacccagtaggcggaggttgcgtacagccg

SEQ ID NO: 6389 - DNA, 285 bp, Homo sapiens; identical to SEQ ID NO: 6352

SEQ ID NO: 6390 - DNA, 258 bp, Homo sapiens
ggtacaatctcagctcactgcaacctctgcctcctgggttcaagtgattcccctgcttcagcctcccaagtagctgctgggattacaggcgcctgccatctcgcccagctaatttttatatttttaatagagacagggtttcaccatgctgtccaggctggtcttaaactcctgaccttaagtgatctacctgcctcagcctcccaaagtgttgggattactggcgcaagccaccgtgccgaccctaaagtgttcttg

SEQ ID NO: 6391 - DNA, 63 bp, Homo sapiens
aatagaaagaaagaaggaaagaaaaatcaatcacctcctcccaccgtcagcccgttagctact

SEQ ID NO: 6392 - DNA, 300 bp, Homo sapiens
tttttgagacgaagtctcgctctgtcgcccaggcaatggcacgatctcggctcactgcaacctccgcctcccgggttcaagccattctcctgcctcagccttctgagtagctgggattacaggtgcgcaccaccatgcccggctaatttttgtattttagtagagatggggtttcaccatgttggccaggctggtctcgaactcctgacatcggatctgcccacctcggcctcccaaagggctgggattacaggtgtaaaccaccacgcctggccaagagatgcattttcaataagttac

SEQ ID NO: 6393 - DNA, 279 bp, Homo sapiens
tctgtcgcccaggctggagtgcagtggcacaatctcggctcactgcaacctccacctcccagattcaaccgattctcctgcctcagcatcccgagtagctgggattataggcactcgccaccactcctggctgattttttatttctagtagaaacagagttttgccatgttggccaggctgccctcgaactcctgacctcaggtgatctgcccacctcagcctcccaaagtgctaggattacaggcgtgagccaccgcacccggcccagtttattttac

SEQ ID NO: 6394 - DNA, 108 bp, Homo sapiens
aaaagaaagaagaaagaaagaaagaaagaaagaaagaagaaagaaagaaagaaagaaagaaagaaagaaagaaagaaagagaaagaaagaaagaaagagaaagaaaga

SEQ ID NO: 6395 - DNA, 234 bp, Homo sapiens
ataaattgctacagcttctattctctgtttctctttgtgtgtattacagacggagtctcgctgtcgcccaggccggagtgcagtggcgcgatctcggctcactgcaggctccgcccccggggttcacgccattctcctgcctcagcctcccgagtagctgggactacaggcgcccgccacctcgcccagctaattttttgtatttttagtagagacggggtttcactgtgttag

SEQ ID NO: 6396 - DNA, 219 bp, Homo sapiens
aggcgtgagcgaccactcccagagccacactcacagttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccc

SEQ ID NO: 6397 - DNA, 120 bp, Homo sapiens
tcacctccaccacctggagggggcgagaagcctctggccccgccccctggatgggtggagcctcctaagtggctgggactacagggacctagtggagggcctggggcaggcccaggcctg

SEQ ID NO: 6398 - DNA, 315 bp, Homo sapiens
tatttttattttttgagacagagtctcactctgtcgcccaggctggagtgcagtggcacgatctcggctcactgtaacctctgcctcccgggttcaagcaattctcctgcctcagcctcccaagtagctgggattacaggtgtgtgccaccacacccagctaatttttgtatttttagtagagatggggttttgccatgttggccaggctggtctcgaactcctgacctcaggcaatcctcctgccttggccttccaaagtgctgggattacaggcatgagccaccacgcctggccaggtcatatgttttttaaa

SEQ ID NO: 6399 - DNA, 216 bp, Homo sapiens; identical to SEQ ID NO: 4022

SEQ ID NO: 6400 - DNA, 168 bp, Homo sapiens
gtaattggctgggtgtggtggctcacgcctgtaatcccagcactttgggaggccgaggcaggtggatcacctgagatcagaagttcaagaccagcctggccaacatggggaaacccgtctctactaaaaatacaaaaattagccaggcgtggtggtgcacacctgtag

SEQ ID NO: 6401 - DNA, 366 bp, Homo sapiens
ctgcctccggccgatttatttatttttatttttatagacaaagtctcgctcttgtcccccaggctggagtgcaatggtacgatctcagctcactacaaactccacctcccgttcaagcgattctcctgtctcagcctcctgaagacggggtttcaccatgttggtcagctaatttttgtgtttttagtagagatggcgtttcaccatgttggccaggctggtcttgaactcctgacctcaggtgatctttttgaggtggagtttcactcttgttgcctaggctggagtgcaatggcgcgatctcggctcactgcaacctccgcctcccgggttcaagcaattctcctgcctcagcctccggagtag

SEQ ID NO: 6402 - DNA, 417 bp, Homo sapiens
atctgccaccacactcagctaatttttgtgtttttagggttttatttatttatttatttatttatagatggagtcttgctctgctgcccaggctggagtgcagtggtgcaatcttggctcactgcaacctccgcctcccaagtagctgggattacaggcatgcaccaccacgcccagctaatttttgtatttttagtagaaatggggtttcaccatgttggtcaggctggtctcgaactcctgacctcaggtgatccacctgcctcggcctcccaaagtactgggattacaggtgtgagtcactgcacccggcctaatttttgtatttttagtagggacggggtttcaccatgttggccaggctggtctcgaactcctgacctcgtgatctctgcccacctcggcctcccaaagtgc

SEQ ID NO: 6403 - DNA, 225 bp, Homo sapiens; identical to SEQ ID NO: 6375

SEQ ID NO: 6404 - DNA, 300 bp, Homo sapiens
tttttgagacgaagtctcgctctgtcgcccaggcaatggcacgatctcggctcactgcaacctccggctcccgggttcaagccattctcctgcctcagccttctgagtagctgggattacaggtgcgcaccaccatgcccggctaatttttgtattttagtagagatggggtttcaccatgttggccaggctggtctcgaactcctgacatcggatctccccgcctcggcctcccaaagggctgggattacaggtgtaaaccaccacgcctggccaagagatgcattttcaataagttac

SEQ ID NO: 6405 - DNA, 3206 bp, Homo sapiens
ctttcacaacagagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 6406 - DNA, 369 bp, Homo sapiens; identical to SEQ ID NO: 6371

SEQ ID NO: 6407 - DNA, 306 bp, Homo sapiens
gtcttgctctgttgcccaggctggagtgcagtggtgcgatcttggctcactgcaacctccgcctcctggcaattagctgggattacaggcgtgtgccaccacgcccagctaatttttgtattttttatagagacggagtttcaccatgttggccaggctggtcctgaactcctgacctcaggtgatccttctgcctcggcctcccaaagtgctgggattacaggtgcgagccaccccaggcgtgctaatttttgtatttttggtagagatggggtttcaccatgttggccaggctggtcttcaact

SEQ ID NO: 6408 - DNA, 378 bp, Homo sapiens
cgccaccaagcccagctaatttttttgtatgatttgtttttgtatgtatattttttaaaagacagagtcttgctctgtcacccgggctggagtgcaatgacgcgatctcggctcactgcaacctctgcctcccaggtagctgggactataggcatgtgccaccacgcccggctgatttttttttttttttttgtatttttagtagagatggggtttcactgtgttagccagcatggtcttgagctcctgaccttggatccccctgcctcggcctcccaaagtgctaggattataggcctaaaccactgcacccagcctacattttgtatttttagtagagatggggattcaccatgttggccagactggtctcgaact

SEQ ID NO: 6409 - DNA, 150 bp, Homo sapiens
ccttcctttcttctgtttttccttccttccttccttcctttctctctctcctccctttccttccttcctttccttctttcttttttgactgggtcttttgggcaggacaaagtattttccatcacacacacacacacacacacacacaca

SEQ ID NO: 6410 - DNA, 369 bp, Homo sapiens
tgtgtgtgtgtgtgtgtgtgtgtgtgtgtgtgtttatttatttacttttcagttttttggagttttctttatttgtttgtgtttttgttaaaaatatatgaaaagaggccctgcgcggtggctcacgcctgtaatcccccaggcgtggtggctcatgcctgtaatcccagcactttgggaggccgaggcgggcagatcagctggagtcaggagtttgagaccagcctggccaatatgagcaagactccgtctcggaaaaaaagaaaaggctggagtggcgtggtggcgcatgcctgtaatcacagctactcgggactgaggcaggagaattgcttgaacccagtaggcggaggttgcgtacagccgaga

SEQ ID NO: 6411 - DNA, 279 bp, Homo sapiens; identical to SEQ ID NO: 6385

SEQ ID NO: 6412 - DNA, 381 bp, Homo sapiens
atttttttctttttgagacagggcttgcttctgtcacccaggctgctggagtgcaatggcacaatttcgactcactgcaacctccacatcccaggttcaagtgattctcctgcctcagcttcccaagtagctgggatttacaggagtcgagaccagcctgaccaacatggtgaaaccccgtctctactaaaaatacaaaaattagtggggcgtggtggttttcattttttttcccagctacttgggaggccaaggcaggagaatggcgtgaacccaggaggcagagcttgcagtgagctgagattgcgccactgcactccagcctgggcaacagaggcgagactctgtctcaaaaaaaaaaaaaaaaaaaaaaaaaaaaaa

SEQ ID NO: 6413 - DNA, 309 bp, Homo sapiens
ttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaatttttttatttttaatagagacagggtttcactatgttggtcaggctggtctcgaactcctgacctcaggtgatctgcccacttcagcatcccaaagtgctgggattacaggcgtgagccactgcacccagccggaagacatattc

SEQ ID NO: 6414 - DNA, 240 bp, Homo sapiens
gcacatcacctgaggtcaggagctggagaccagcctggccaacatggtgaaaccccatctctactaaaaatagaaaaattagccgagcatggtggcagctgctttagcttccaggtacttgggaggctgaggcaggagaattgcttgaacccgggaggcggaggttgcagtgagccaagattgtgccactgcactccagcctgggcgacagagcaaggctctgtttcaagaaaaaaagaa

SEQ ID NO: 6415 - DNA, 417 bp, Homo sapiens; identical to SEQ ID NO: 6402

SEQ ID NO: 6416 - DNA, 315 bp, Homo sapiens
tatttttattttttgagacagagtctcactctgtcgcccaggctggagtgcagtggcatgatctcggctcactgtaacctctgcctcccgggttcaagcaattctcctgcctcagcctcccaagtagctgggattacaggtgtgtgccaccacacccagctaatttttgtatttttagtagagatggggttttgccatgttggccaggctagtctcgaactcctgacctcaggcaatcctcctgccttggccttccaaagtgctgggattacaggcatgagccaccacgcctggccaggtcatatgttttttaaa

SEQ ID NO: 6417 - DNA, 459 bp, Homo sapiens
gtgaggggtgcctctgcccggccacccctactgggaagtgaggagcccctcagcccggccagccgcccggtccgggagggaggtgggggggtcagccccccgcctggccagccgccctgtccgggagggaggtgggggggtcagccctccgcccggccagccgccccgtctgggagggaggtgggggtgtcagccccccgcccggccagccgccccgtccgggaggtgaggggcgcctctgcccggccgcccctactgggaagtgaggagcccctctgcccggccagccgccccgtccgggagggaggtgggggtgtcagccccccgcccggccagccgccccgtccgggagggaggggcgcctctgcccggccgcccctactgggaagtgaggagcccctctgcgcggccaccaccccgtctgggaggtgtgcccaacagctcattgagaacgggcca

SEQ ID NO: 6418 - DNA, 2169 bp, Homo sapiens
gctttttgcttttcatcacctgcaagatgtacataaaaatcacataagctggaattcaacaaaagacctctgactatgtgaagatacggtgggaagatgactgaccgcaagacaggaagagagccctcaccgaggaaccaaattggccagtatcttgattttggatttctcaacctcaagaaccatgagaaatgaatgtctgctgttcaagccacccagtcaatgaaaaagtttggaaaccttcatctagaaagtggtctagcaaagtgtggtccatggatgagtttgatctgcaaactgcttgttattggttcatgacaaggtgtcagaaggaggctggcaaatttggcactcacagagggaaacctatgtgcttcgtgaggtcattgcttagagtacaactgctaccaagaacattccctgcaaactcttttgtgatcagtttcttcccttctctcatataccctctgcaggtctaccaattgcattttgagagctcagataagcagagagcaatgcaatttgtcacagaaggatgattatgtatatgcactgtcatgtctatttccatgcctaactcaaaggagacacaaggagaaagtgagctcagcctggataaattggagattgtgatgacttctaggaagcctcaggaaagagaaacaaagacaacactggcctgctgctctctgcaatggtgggacccttgtgggataactgttttaggaatgaaggtgtctaccctctctagaaatgaaaatgcaagtttggctgtggttaagtattggatggaggcaaaaagaaactgacatattttcttcttttcaattgtttgattcaccctgaagggcatggctgcttaatttttttctccagagataggtggacagataaagacaggaaagtaacatccacagactgccctctgtgaaggtgacagtgatgaaaggaatgcttgatctgaacactggtaaataaagtgaccgcatatttccctagccaggagagcaatctggctcaaaagaaacgagaacaatgacattactgccaggctgctcctaagcctttggctattctgttcagtgcacaaaaaaaagcagtgaacatagctgtgacctgccttgttggtagtatcacaattctttggggctccactttaagaaattgagacctacctaccttaatccttggggggttaagctttcagactggaatgataactgaactattcatttgcagtaattctgggttttgtgcatattttaaaaaggaataccgggcttgcctatattcattacaacgtcctcccagctttcaaatcttccaatacaatgcctcttctctagtcttttaagcacatcctgtgactggatatgattatgggagatttacatgcatccttgtctattgtatcaaaagatcagggaataaaatgcccatcattaaaaccccaaagtgattggattggcatgaggaatggggatggggctggcatggaagagagggttctgactctgagatttcatgaaatgcaaaacaataggacagctgctcttccataaacagattattattattatttctacctagacagcttgatagcagccattatcttctttctgggtgtcttatcaagttccggctgtgtgcagcatgggtgataaggaaagagaaatgtcacccatgggattgccaaggattatttctatgcactgctgttcagcaacagccaatctctcagaactgagaagaagtcctattgttcacgctgggcagttgctattctgactatcccaagagagcagaaaagggatgtagttgccattgtgcaaaagattgatatttcattactctcagctaaagttctgaaaagcagaatcatcatgaaatatctttgaagagagaaaagacaagggaagaaaagaagaacgaaatgagttcagagctttttagaactgtgagggagtgcgaaaaaagaaaggtgtaatactttcaaacagtggaagttaaaatgccaggcgtgtaagcctcagtgaaattgagcagcatcacgtcaccacgacttgtggtccagctgtttattgcaaagactccatcctgcgttactcatcagaaaatagttaactttgtatctggcattattttaattaaaaaaaaagttaacttact

SEQ ID NO: 6419 - DNA, 315 bp, Homo sapiens; identical to SEQ ID NO: 6398

SEQ ID NO: 6420 - DNA, 108 bp, Homo sapiens; identical to SEQ ID NO: 6394

SEQ ID NO: 6421 - DNA, 417 bp, Homo sapiens; identical to SEQ ID NO: 6402

SEQ ID NO: 6422 - DNA, 108 bp, Homo sapiens; identical to SEQ ID NO: 6394

SEQ ID NO: 6423 - DNA, 105 bp, Homo sapiens
tcacccaataaattactatttgaccccagagtgggtggaagggtgagccatgtgttttttttattcccaccctttgtgcttctcccgggccctcccgggctcccc

SEQ ID NO: 6424 - DNA, 300 bp, Homo sapiens; identical to SEQ ID NO: 6404

SEQ ID NO: 6425 - DNA, 396 bp, Homo sapiens; identical to SEQ ID NO: 6364

SEQ ID NO: 6426 - DNA, 111 bp, Homo sapiens; identical to SEQ ID NO: 6365

SEQ ID NO: 6427 - DNA, 225 bp, Homo sapiens; identical to SEQ ID NO: 6375

SEQ ID NO: 6428 - DNA, 333 bp, Homo sapiens
ttctttttttttttttttttaagacatactcttgctctgttgcccaggctggagtgcagtggtgcaatcttggctcactgcaacatccccctctcaagttcaagcaattctcctgcctcagcctcccaagtagctgggattacaggcgtgtgccaccacgcccagctaatttttgtattttttatagagacggagtttcaccatgttggccaggctggtcctgaactcctgacctcaggtgatccttctgcctcggcctcccaaagtgctgggattacaggtgcgagccaccgtgcccagcccctgtccatacttttttttttttttgaggca

SEQ ID NO: 6429 - DNA, 459 bp, Homo sapiens; identical to SEQ ID NO: 6417

SEQ ID NO: 6430 - DNA, 270 bp, Homo sapiens
caatggagtgatctcggctcactgcaacctccgcctcctgggttcaagcgattctcatgcctcaaccttccgactagctgggattacaggcatgtgccaccacgcccggctaatttttgttttttcatagagatggggtttctgcatgttggtcagactggtcttgaactcccaacctcaggtgatccgcctgcctcggcctcccaaagtgctgggattacaggagtgagccaccacgcctggcctcattttattattttattaatgatt

SEQ ID NO: 6431 - DNA, 387 bp, Homo sapiens
tggcgggcgcctgtaatcccagctactcgggaggctgaggcaggagaatggtgtgaacccaggagtaccagaatacaggaaaaggatattgcattcctggcattcagcctgggtgacagagtgagactctatctccaaaaaaaaaaaaaaaaaaaaaaaaaaaatcagtcacgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgagttgctggaacttgctggtctccaactcctga

SEQ ID NO: 6432 - DNA, 354 bp, Homo sapiens
tggtgtgcacctgtggccccagctactcgggaggttgaggtgggaggatcgcttgagcccaacaggtcgaggttgcagtcagccaagatcgcgccactgcactacagcctgggcaacagaacaagactctgtctcaaaaaaaaaaaaaaaaaatctttatttaataaagtttgtttgtttttgagacgcagtcttactctgtcacccaggctggagcacagtggcatgatctcggctcactgcaacctccgcctcccgggttctagctattctcctgtctcagcctcccaagtcgctggtattacaggcgcctgccaccacacccagctaatttttgtatttttagtagagaca

SEQ ID NO: 6433 - DNA, 315 bp, Homo sapiens; identical to SEQ ID NO: 6398

SEQ ID NO: 6434 - DNA, 351 bp, Homo sapiens
gacagagtcttgctctgtcacccgggctggagtgcaatgacgcgatctcggctcactgcaacctctgcctcccagctggctgggattacaggcacgcaccaccacgtctggctaagttttgtatttttagtagagatggggattcaccatgttggccagactggtctcgaactcccgacctcaggtgatctgcccacctcggccacccaaagtgctgggattacaggcgtgggccactgctcccggccggaagaagttttgttctttagagacggggtttctccatgttggtcaggctggtctcaaacccctggcctcaagccgtcctctcaccttggcctcccaaagtgc

SEQ ID NO: 6435 - DNA, 108 bp, Homo sapiens
aaagaaaagaaagaagaaagaaagaaagaaagaaagaagaaagaaagaaagaaagaaagaaagaaagaaagaaagagagagaaagaaagaaagaaagagaaagaaaga

SEQ ID NO: 6436 - DNA, 306 bp, Homo sapiens
tttcatttatttttatttatttgtttttttctttttttgagacgaagtctcgctctgtcgcccaggctggagtacagtggcacgatctcggctcactgcaagctccgcctcccgggttcacgctattctgcctcagcctcccgagtagctgggactacaggcgcccgccaccacgccaggctaattttttgtattttttatagagatggggtttcaccatgctggtctcgaattcctgatctcatctgcttgccttggcctcccaaagtgctaggattacaggcacccgccaccatacctggctaa

SEQ ID NO: 6437 - DNA, 420 bp, Homo sapiens; identical to SEQ ID NO: 6380

SEQ ID NO: 6438 - DNA, 387 bp, Homo sapiens
tggcgggcgcctgtaatcccagctactcgggaggctgaggcaggagaatggtgtgaacccaggagtaccagaatacaggaaaaggatattgcattcctggcattcagcctgggtgacagagtgagactctatctccaaaaaaaaaaaaaaaaaagcaagaataacaaaacttctttatttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgagttgctggaacttgctggtctccaactcctga

SEQ ID NO: 6439 - DNA, 306 bp, Homo sapiens; identical to SEQ ID NO: 6436

SEQ ID NO: 6440 - DNA, 108 bp, Homo sapiens
aaaagaaagaagaaagaaagaaagaaagaaagaagaaagaaagaaagaaagaaagaaagaaagaaagaaagaaagaaagagaaagaaagaaagaaagagaaagaaaga

SEQ ID NO: 6441 - DNA, 279 bp, Homo sapiens; identical to SEQ ID NO: 6385

SEQ ID NO: 6442 - DNA, 108 bp, Homo sapiens; identical to SEQ ID NO: 6394

SEQ ID NO: 6443 - DNA, 333 bp, Homo sapiens
tgcaccaggtatttttatttttatcttttttgttttatttttatttatttatttttttttttgagatggagtcttgctctgtcacccaggctggagtgcagtggcgcgatctcggctcactgcaagctccacctcccaggttcatgccattatcctgcctcagcctcccgagtagctgggactacaggcgcccgccaccacgcctggctaattttttgtatgtttagtaaagacagggtttcacgatggtctcaatctcctgacattgcaatctgcctgccttggcctcctaaagtgctgggactacaggcgcccgccaccacgcccggctaa

SEQ ID NO: 6444 - DNA, 354 bp, Homo sapiens
tggtgtgcacctgtggccccagctactcgggaggttgaggtgggaggatcgcttgagcccaacaggtcgaggttgcagtcacccaagatcgcgccactgcactacagcctgggcaacagaacaagactctgtctcaaaaaaaaaaaaaaaaaaaaaaaaattaataaagtttgtttgtttttgagacgcagtcttactctgtcacccaggctggagcacagtggcatgatctcggctcactgcaacctccgcctcccgggttctagctattctcctgtctcagcctcccaagtcgctggtattacaggcgcctgccaccacacccagctaatttttgtatttttagtagagaca

SEQ ID NO: 6445 - DNA, 470 bp, Homo sapiens; identical to SEQ ID NO: 6186

SEQ ID NO: 6446 - DNA, 126 bp, Homo sapiens
aaggaggagaacgaggaggagaaggtgaaggagaaagaaaagaacaaaaagaggaagaagaggaagaagtcacaatcaaggagagtatatcaccaagaaaagacccacatattgtgggtatctact

SEQ ID NO: 6447 - DNA, 306 bp, Homo sapiens; identical to SEQ ID NO: 6407

SEQ ID NO: 6448 - DNA, 330 bp, Homo sapiens
tttttttttttttttggaaatggggtctggctctgtcacccaggctggagtgcagtggtgcaatctcggctcactgcaacctccgcctcctggcaattagctgggattacaggcgtgtgccaccacgcccagctaatttttgtattttttatagagacggagtttcaccatgttggccaggctggtcctgaactcctgacctcaggtgatccttctgcctcggcctcccaaagtgctgggattacaggtgcgagccaccccaggcgtgctaatttttgtatttttggtagagatggggtttcaccatgttggccaggctggtcttcaact

SEQ ID NO: 6449 - DNA, 72 bp, Homo sapiens
cgagaaacagaaaggaccataacagatgatggatggatggatggatggatggatggatggatggatggatgg

SEQ ID NO: 6450 - DNA, 369 bp, Homo sapiens
tttatttttttgagatggagtctttctctgtcgcccaggttggagtgcagtggcacaatctcagctcactgcaacctctgcctcccaggttcaagccattcttctgcctcagcctcccaagtagctaggattacagatgtgggatatgcacctggccagcatggtgaaaccccgtctctactaaaaatacaaaaattagctggatatggtgtggctaatgtctattcccagctactcgggaggctgaggcaggagaatggcgtgaacccgggaggtggaacttgcagtgagccgagatcgcgccactgtactccagcctgggcgacagcgagactccgtctcaaaaaaaaaaaaaaaaaaaaaaaaaaa

SEQ ID NO: 6451 - DNA, 456 bp, Homo sapiens
tctaggttctatattggctgtgatctttgtactaactgctattatggagaatgtgttggcatcgcagaaaaggaggctaagaaaatggatgtgtacatctgtaatgattgtaaatgggcacaagagggcagcagtgaggaattgtactgtatctgcagaacacctgcaggatcttgcagattttttattggccatgatcggtgtcagaattggtaccatgggtgctgcattggcatcttgcagagtgaggcagagctcattgatgagtatgtctgtccacagtgccagtcaacagaggatgtcatgacagtgctcacaccactaacagagaaggatgatgaggagttgaagagggtgctccgttccttacaggcccataagatggcccggcctttccttgaaccagtagaccctaatgatgcaccagattattatggtgttattaaggaacctgtg

SEQ ID NO: 6452 - DNA, 120 bp, Homo sapiens; identical to SEQ ID NO: 6397

SEQ ID NO: 6453 - DNA, 96 bp, Homo sapiens
gcgaaaccccgtctccaccaacctggccaaagtggtgaaaccccatctctattaaaaatacaaaaattagccaggcgtggtggtgtgcacctgtaa

SEQ ID NO: 6454 - DNA, 417 bp, Homo sapiens
ggcacaatctcggctcactgcaacctctgcctcctggattcaagtgattctcctgcctcagcctcccgagtagctgggattataggtgcgcaccatcacgcccagctaatttttgtatttttagtagagatggggtttcaccatgttggtcaggctggtctcaaactcctgacctcggatccgcctgcctcggcctcacaaagtgctgggattacaggtgtgagccaccacaactggctttttttttctatttttctgaagaatagtcaagagaccgcccgtttttttttttggttttttttttttgagatggagtcttactctgtcgcccaggctggagtgcagtggcgtgatctcagctcactgcaacctccgcctcccaggcacaccattctcctgcctcagcctcccgagtag

SEQ ID NO: 6455 - DNA, 105 bp, Homo sapiens; identical to SEQ ID NO: 6423

SEQ ID NO: 6456 - DNA, 366 bp, Homo sapiens
tttatttttttgagatggagtctttctctgtcgcccaggttggagtgcagtggcacaatctcagctcactgcaacctctgcctcccaggttcaagccattcttctgcctcagcctcccaagtagctaggattacagatgtgggatatgcacctggccagcatggtgaaaccccgtctctactaaaaatacaaaaattagctggatatggtgtggctaatgtctattcccagctactcgggaggctgaggcaggagaatggcgtgaacccgggaggtggaacttgcagtgagccgagatcgcgccactgtactccagcctgggcgacagcgagactccgtctcaaaaaaaaaaaaaaaaaaaaaaag

SEQ ID NO: 6457 - DNA, 459 bp, Homo sapiens; identical to SEQ ID NO: 6417

SEQ ID NO: 6458 - DNA, 212 bp, Homo sapiens
atctcggctcactgcaacctctgcctcctgggttcaagcaattctcttgcctcagcctcccaagtagctgggattacaggcgcacatcaccaagcccagctaatttttgtatttttagtagagactgagtttcaccatgttggccaggctggtctcaaactcctgactaatgaatggctcccagtctgcctcccaaagtgctgggattacag

SEQ ID NO: 6459 - DNA, 363 bp, Homo sapiens
tgtgtgtgtgtgtgtgtgtgtgtgtgtgtgtgtgtgtttatttacttttcagttttttggagttttctttatttgtttgtgtttttgatctgggcaaaagagcaagattctgtctcaaaaaaaaaaaaaaaaaaaccaggcgtggtggctcatgcctgtaatcccagcactttgggaggccgaggcgggcagatcacaaaacaggagttcgagactagcctgagcaacatggcgaaacctcccaaagtgctgggattacagaactggccgggcatggtggccagcacctgtaatcccagctacgggaggctgaagcaggagaatcacttgatccggggaggcagaggttgcagtgagccaaga

SEQ ID NO: 6460 - DNA, 276 bp, Homo sapiens
actttttttttttttttttttgagacagattgtcgctctgtcaccaggctggagtgcagtggcataatctctgctcactgcaaactctgcctcccaggttcaagcgattctcctgcctcagcctcccaagcagctaggactataggtgcatgccaccacgcccagctaatttttgtattttttgagacagggtttcaccatgttggccaggatggtctccttgacctcgtgatccacccacctcggcctcccaaagtgctgggattacaggtgtga

SEQ ID NO: 6461 - DNA, 369 bp, Homo sapiens; identical to SEQ ID NO: 6371

SEQ ID NO: 6462 - DNA, 762 bp, Homo sapiens
aaagtctcccatgtctatttctttctacacagacacggcaaccatccgatttctcaatcttttccccacctttcccgcctttctattccgcaaagccgccattgtcatcctggcccgttctcaatgagctgttgggcacacctcccagacggggcggtggccgggcagaggggctcctcacttcccagtaggggcggccgggcagaggcgcccctcacctcccggacggggcggctggccgggcagggggccccccccacctccctcccggactgggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacggtgggcggccgggcagagacgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggct

SEQ ID NO: 6463 - DNA, 596 bp, Homo sapiens
agttttgccctgctgagctggcaggctggtggatgcctggagggtgcacatgctgcctggcacagatgcaacgtgggctggtgcgaatggggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccagga

SEQ ID NO: 6464 - DNA, 584 bp, Homo sapiens
tgcgccacctgacccacaggccggtcgtggagctgcgaccccggccctaggggaccagacgtggaggttagatcttaaggtgaccgtggtgtttggaaatgcagaatcttgaccttcaagctgttcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtacc

SEQ ID NO: 6465 - DNA, 581 bp, Homo sapiens
agatgcaacgtgggctggtgcgaatgggggaccagacgtggaggttagatcttaaggtgaccgtggtgtttggaaatgcagaatcttgaccttcaagctgttcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtc

SEQ ID NO: 6466 - DNA, 882 bp, Homo sapiens
gaaagggagggctcggtccgggaggaggggagcagggatgacggcgggagagggattgggcgaggagcgtggggaaaggaggtggaagtaggggagagaggaagaggagcgagtaggcaagaggggcaaaccgggactttcggaggacggagagccaaatggtgggagcagggctttggtttgctgtgaggggcgtgggagagggaatcgcgggtgaggagggggctgcgtgtggggaggaggcttgtgtgaggggcaggtgggccctggtctagccctgggcgcaaccgccagccggctgggcggggagagagcttggagtccagcccggctgggagctgagggccaagcaatgggcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattct

SEQ ID NO: 6467 - DNA, 3857 bp, Homo sapiens
tgtagtttccgccgcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattacttatcatccaattatttggattggagaagagggggcattcactcctctttttcttattttttttggaaatagagtctcaacttactctgtcgccagggctggagtgcagtgacgtgatcacagttcactgcagcctcaaactcccaggctcaagcaatcttcctacctcagccctcctgagtaattgggactacagaacagagaatgtcagtatccaataggatgccagtggaattccctgacgattccatccatgcggctctgctggagcagggtagtgtcctaggctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataa

SEQ ID NO: 6468 - DNA, 306 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcccaca

SEQ ID NO: 6469 - DNA, 371 bp, Homo sapiens
gagcaaaactgacaagtcaaggcaggaagatgtcgccatcacaactcattgggtttctgctgctctgggttccagcctccaggggtgaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccatctcaggggtcccctcgaggttcagtggcagtggatctgggacagatttcaccctcaccatcaatagcctggaagctgaagatgctgcagcgtattactgtcatcagagtagtagtttacct

SEQ ID NO: 6470 - DNA, 499 bp, Homo sapiens
agaacggaccagatgggtccagcagtgctgggtcaaggccaggaggggcagccggaagcgcgcgcatgctctggactcctgcagccgccgaaacggccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggaatcctattcatcttcttcaccgatatggtctgtggactctgatgagccaaatctgacatcagttctggaacgtctagaagatactaaggagaacagttcggtgaggaaagaaaccaagctattttctcttttcctcatgaacattatatttagaaattaaatgttaagtgataatattatataaaaacatgattaacaactgtaatcttagaggaattaaagtctgggtattttaagtcctccaaatctta

SEQ ID NO: 6471 - DNA, 1523 bp, Homo sapiens
gcctgaataaaaggccgcacacgtgtgtcgggttttcttgggtgcgatagaggacctgcccttcagcagcggtggcgccctgctagggtcgtttgtttctttctgctgtgagttagtttagcgtgagattgcagatgttaccatcggctggaattatttcgtctgcgctggagaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttagaaaaggtcaaaggcatataagatatggcatgtgctctgagagaactcatcatctatccagaacctactcatcacttttggaaagagaagagaaactagcattctatggagtacttaccatgtgccagatttggtgtgagacatagtacgagtgttactcatttacgtctcatggccaacctccaatgtggacatttagcatctccatcttacaagtgagaaatttcactgtagagaggttaaatatcatgtgtcattgattctgtgacatgtattattttcacatttgaacatctgaaatatagatatgtctaaaagggcttttctttcttggtagtaagataactgtaggtctttgcagtagtgtcttagattatgtgaaatatggtattttggcaagtgtacatggctaagaacaagtggaatcagaattcaacttaagtttgcttgactccaaagcttatgtgttttccagtataatgtgctgcagtatcaatggtctgtatgaacaaaggccatatcatttttattgacaaagtatagaaacggggaaatggtgactgaactggaacttgcatcatctaattccataactgaggagacaatagcctggggactgcatgtatcccacaggatgttaaaaaattgagaaaatgttatttcatgatcttcacttctctgttgattataacttatttttgaagaggctaaaataaatggcaaactcttgtatgg

SEQ ID NO: 6472 - DNA, 312 bp, Homo sapiens
gaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttccaca

SEQ ID NO: 6473 - DNA, 342 bp, Homo sapiens
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagc

SEQ ID NO: 6474 - DNA, 2213 bp, Homo sapiens
actacctggtgagtgccggcgcgcgggagggcgggtgagtccggccgggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtggcgctcggggagccgccgaggagggggccgccgcgcccccgggaccacctgcgcctgctcatctgcatccagtcccggtgccagcgcaacgcctccctggaggccatcatgggcctggagagcagcagtgagctcttcaccatctctgtgaatggcgtcctgtacctgcagatggggcagtggacctccgtgttcttggacaacgccagcggctgctccctcacagtgcgcagtggctcccacttcagtgctgtcctcctgggcgtgtgagcggccaccacaggcccttcctctcaggggcaaatggagcacagatctagacaatgtgtggacagtgtcagagtagcagtggccacatggaggaggaggcccacccggaactctgcccacactggccactgcagttcagcccacagagccactgcaggcaggcctacggacgtgacacgcacgctggtggtcccggagccagggttgattcaggacaccatcttggactctttcctggcctgctcagcacctgcccagatggcctctgcgtctttcctgtgcccagccccaccttttccacctctcttcatgttctcatggagtgcaaagtgcaccagccagggcccctacctgggagagggtcagctgacgcagggctgagggggctgccacagggacgtacgctgtgtgttcttactgcttagaagggacggggtcactcaccactcccctggtctccatctgggctccttggtcttccctgcccctcccctaaccgtgttctacctgccagtggagctgagcactgcctagcctgggccagaggggcactggacaagggcctttgggggacagtaagtctgggcccagcttctagttctaatgtgtgcaagattaactcacaaattcacctcagaaggcctttccaaatgggagctccactcttcccctcctctgcaaatcttcacagccaaggccccttccaccctctccagaggtggatgagatcccttttcccctcccctctgaggtgctgactcactggtaggagccacccaccagaggaaagatctagaacgtctttacagattggagacagccgggcctgctgacccatcatccgaatagctgaagcagagtcttccaccaggggtgccagggcctggctgggtccagcggctctgggatgagcctcccaagcatctttcccacttgggtggccatgcggcgctgacattggacaggtggtggacgagagatggtcccgagaaagggtggtcttgggagggctggtcccaagcctgctgtgctcctgtggcagtgatggggcctggggatggggacggcagctctcatgaggacacacaggctgtgagcccgcagcctcctcaaatgtagcctcccacattttccccaaagtacaggactgtcccagagtaggtagtgaagaggacaaggccctcggcagcgacctccagggcctcctacctgctgaggaagagttaacccactgcctccccacacaacaggctacgaagaacctggtgcctcaggacctcctgggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcatttttctcagtgtgttatgcagcaatttattaaagtatttattgtctaat

SEQ ID NO: 6475 - DNA, 2974 bp, Homo sapiens
agtagagacagggtttcaccatgttcgccaggctgctctcaaactcctgacctcagctgatccacccgcctctgcctcccaaagtgttgggattacaagcgtgagccaccgtgcctgggctttttttttttttttgacacagggtcttgctctgttgcctgggctggagtgcagtgccacgatcttggctccctgcagccttgacctcctgggctcaagcagtcctcccaccccagcctctgagtagctgggactacaagtgcatgctgccacaccaggtgtgttcatatgggtgtgtgccgcatgtgtgtgggcaggtgtgtacagacaggtgtgtgcgggcggttgtatgcatgtgtgtggcagatgtattcagctaaggtgtgtgcaggtaggtatgtgtgggcaggtgtgtgtgtgtgtgtgtgtgtgcacacaaggcaaagggagccccggaagggtagttgcttgggaggatgtggggcaatcagtgggatctggggcaggagtgacaaccgaacccagcagggggatcccaggccaaaggtgtggctgcataaaggccaagtggccactggaggcagaggatgcatggggagaagagccacgggagagggcaggctgggaggcaggtacccctaaagcagcagtcggtcagtggtgagagccagcagggggcgaggcagggggctggccagtctacctgttacctgagctctgcctttctctgtaacgggagcttcccagcaggcagcatgtccctgtgggaccctcaacccaaacaggcctttccctccgtgctctggtgttcgtgggctggagtccctggcaggaggactgggcagagagaccccagagtccaagaaaggagaggtgactttgtgagcaaactgggtgctgccgtgggtggggagcccctggccctttttggacctcactcctggcctgggatggggcacagagttccagggctgggagctggttttctgctctttgctggttttgcccttgagccgtgggattcttatcacgtggtgtttgagggctggaccattgacatgaggcggaatgagccagagaggactcgaagcctcagtgctcctggccctctgtgagggctgcagccgtgtgccctggagtatctgcagccttgggcctctgggtgggcaggggagttgcttgtgctcaaagccccctcctgggaatcctgggactcccctcccccagaacctggagttgccccctctggagcagggcaggctggagaccagccctgtcagcttccccaccttggggttgtgtgtcctcagctggagtggggacactgtccagcctgccagtgtgagcgtctgagcctcaaaatagactccatttttccagagccgtggattcccctgggctgggaggccataaacgggcggcagcccagggtcttggtcaccaggtcaggcccagcagcttcctccagggccaccccctctgcccaccaggggagctggagtttggttccatctccagggtactgatgtggctcatgctctagggaaccaggaagctggacctgggtaggtgccggggagctgggatcacctttaggaagctcatccccgttttacagaaaggaaatcaaggctcagcagaagccgtgtgcccagccctgcaccagggagagcagggtcagttagctgaggggctgcaggccctctgctgcagtgagaggcagctggacatcagagatgctgacggccccaccagcccacgtggggaggggctctggccacagtgctcccggtgctggggctgaggcctccacgtctgagcctgagacgtggaggatcaaggccgctgagcgggcttgatcgcttcaagttgtgtgtgtgtctggctcgtctggccagctctctgctacctcgtagggttgcctggagcccactggctgcctgtggctggaccccagcctgtgggggacaccctggtaggcagagggaccatgcactttgttcacatctgaagggaggaggcaggtgtgccctgcgcctccccctccttctgtgctggagagggtggccctgcgtcccatgcctgcgctggcttctgtttcagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 6476 - DNA, 3752 bp, Homo sapiens
atgacaaggcctagcactgggagtcattaggcaccagaaccctgaatgccgagatagagggatggctgatctcatgctaatgaggtttagaccatgttgagccctacttttgttctgtgggatgttggatatcccttatacacctatggctccatcttcatcgttattgtaattatctggcaagtgaaaaggagccaccatgaattgaacttggaagttgaaaggagctgctgctggcgtcaccaaaaagtcaggcaaagagctagagatgcagcatcaacagctaggagactttctcaggaagaagatcagaagccacaagagctgttctctgtcatgaaaagccagggctggcttcccccagagggaagtgtgcggcgaatcctatgtacagatccctgttgccaaatttgcaatgctatggctctggagattcagcagttgctggcggatgagaatgactagatctccccaactttgtcgaggagtccatcacaggtctcctcttgcctagagatcttgtctctgtctagtgtatcctttgagcagagtatagagctccattccagaaatatcagagagctttcactggcatctataaacccaacactgtcacaattaacagatcagaaatctttaacccagtcagctgcccagtcaacgtatgcagatggcatacaagattactgggctgatcacctccagctagggccggaatttcaagtgccagctgtgctccggggcccaaacaccatagcttcttcaaggcttgacaagccaagggctccactgaaccaggaggagatgagcagagcaaccccagccttgtccagggaaaccaaggccagcatcacttgaatttccaggtctccttgctgtccctgaacccagaaaccctgaaccggatgcatccgatggccttgcatatggtcctccctgcccacctgccatttctcagtcctgaagtgctgaggcttcttgaggtacatgttaaaaaatggatgcatttccagaggtgggggctcccaagacgtgtggaggagtccctgaggcagcttatgccaaacccaccattgtattaccaacctggaaatgaccagccagtttctttcaacctgaataatacttctcaggtctctcttcacagatctgagaccatttccctccagacctggtgttcatgtgtggctggccagcccatccagaccttctgggtttctgaatggtccacaatgaacccagaacaaagacaccactgtcagcaaactccaaaccctatggctctagccttgccctctccagcccttaaagccctaagtggcccccatccacagtctgggggacaagataatgactcagggagtgatctccagcagaaatacagccagctattctgtgggctcccttctctgcacagtgagtccctggttgccactttcatgggatctcaaggccttcccaagattgaaaatgtgcccaagccccccttgaaggatccttttctcttcaatgatctctccttcccccaactgctccctaaaacttcaccccagtcagccccaccctcttccccactttcgccaaattgggtgtctccatctgaccatcaacgagctcagatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagtcgattcgccatcgctggggcctgcctcagaagatccagcagtccatccagttgctccttacctccactgaccagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggtactgcagacagcaagtgacccagacctacatcacaaagttatgccctggatgccaacggcccttgatcagcagcaacaggccttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagtcccgtggaaatcccagcagagcctctgatttagatggtttcatttgaagaacagtgtataagtcttgggccatgccctcaaggcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgctgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagcagtaccccagggttctgcccactcggtctccaagatctcacaacccagtggggacatgacagaggcccacatgccttgtgttcaggtagaggccagtgtgaacaaccccagcctggaggaaccctgtggccctgagcctcaaagccctagcaagagcaaggacccagcccatgtccccatgctagcaggaaacagagaggacccagaggaaaccaaagcagccagggactacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagtttaagctcccacagctacctccacgagtccctggggagaaagagtctgagaaggacctgcaagacagtcaaaccaagctaactgtcatccttgaaccagcaacaattcctgagaatacccagactgtggtgccccagcttcacagggtcagcctttcctgagccaaccaactcaggctaagcctttgcagggccaaactttgcaatgccaagttttacatgggctggtgatgccagcccatactcaaaagaagcccagccttacagagtctagcttcagaaataaaattaaatgttttctgg

SEQ ID NO: 6477 - DNA, 2447 bp, Homo sapiens
ctaaaagccctggggctccggaaagccgacagtgctttacaggacacctgcaaagaggaacaggggcaaatccgaggcggagaccatatgactacgcgtggcactggcctatcccacagcagttggtgttaatgcgtgtcactggaggcatacggggagagggcgaaacaaagggtggtgtccaggaacgtgccggtggaagggggaaacgggtgacctttccatcaatgccaaggaaaatcgaaaaacacgtgggacacgcggggtgggggggggtcctgtgcctgacccaagccacgttttcaaatgcctaccagaggagcaaagaggtttctgcaaaattcgccccaccccaaaccatccaaggccctggcagccctgacacaactttggctgcaccgagccccaggaccagcccccaaccctagaccagtcccttgggttccctgatattcttttctgccagatgatcaagggcttcagttcacccaggagcagaggagaggatgtccctcaagaatgagacaggaagtgcagaggaaatgcgacaccacctgtcctggaagacaaggccagtcacgttcacctagcgctcattctaggcaatccaaccacccatgaggggaaacgtggagaaggaagcttccctgcctgagacacctaaggaagtcaagagttcccgggtcatgagaccagcccaatcaagcagaaacaggtttggagagagaaacaatcacggcacggatctcgaagaaatgtctccctgacggactgggaagccatcttcgttgaaggcatttggccagagctagaggcatccaggcccctgagaaacaggggaggcagagtaagatggaggacagagcagaggccggagcccaggcagcatacagcaccgtgccaccgccaagggcataaggggtggggttccaaaagggtggcttgtccagggaggccagcgttccagggacagggattgttgccatctctcattcccggcttcctcttgctgactgtatcgtggtgtggcttcatttctcagagaagagccgtgaaaagactcaagcatcttctctgacgtgggtccgctgctctcctgtaggacaaagagctcctgtgggattctgcagtgtgttcgttttgatgctagaaaagaggctgctcaggatggggatgagacttcaattgctccgagaccgacgcatctcctcacgtgggccaggccttcacagagccaaagcggatccacagcagcaaaaacgattgacaaccggcctcatgacccaggcagagacgcagaaagaggctcaacaaagacaggccgccatgcgaaaaaccgctttgtggcacacagggcacctccagccaaaaacacacacgcacacgggcatgcacacacaaacccacagagagagggaaagaaacacacagagactgagagacagagagagaagagagaatgggagacacacacacagacacacacacacactcacacacacacacacacacagagacacacacacagcgtcatacagaagaggcattgaaacacacaccaccaggcaacccctgaggctgcggggttctgctcacgatgagaacgaccctcgggtgagagagcagcccaggggcacgcaggctgacctgtcctcgagatcacggatggcggcacgacttttggggagactcaccccaaccaacaccgtccgggcaggcctgaggctgggatcccgtgctgcttcccccgaccccgcctggggtttcctcatcgtggtcggccctttgtgactcctggcatccggagacgttcacgtcgaccccgtggagaggtcaggccggatcctcagagccccgacacccaagcactgccacggagggctcctgctttgccaagcctcggggattggtttctaagacaaccgtgggaaccactgtgacgggagaaaccgctcccgcctcgcgcatgcgcattggctgagccgactcgcgctccgctcctggcagtgtggctgcgtcccctttaaatactgccgccgcctcgcggcggcagcgcggttcctcctgccgccatggcggcggctggatccgggatccggtttagggcggcgtgggagagggagccgcgggtgtcttgtcctgtcccagggccaaacccctaggagtcctgtcctcaggacctccttgagccgacttccaccgagggaggtggagcttcaggatgcctgctgtgttctccggactcccgttcagatccgattttggacccctccgagtgagataggataggctcaccacatctggtgaggcaggcagggcctcgctgcaacacagaatgatcccgtaggtctcaaggcctacttgtactgttgtacataatgtatataattgacttttattcactcgacaaaatttcctaaaaatacatccaaatgattgcattaatt

SEQ ID NO: 6478 - DNA, 381 bp, Homo sapiens
atggggatgagacttcaattgctccgagaccgacgcatctcctcacgtgggccaggccttcacagagccaaagcggatccacagcagcaaaaacgattgacaaccggcctcatgacccaggcagagacgcagaaagaggctcaacaaagacaggccgccatgcgaaaaaccgctttgtggcacacagggcacctccagccaaaaacacacacgcacacgggcatgcacacacaaacccacagagagagggaaagaaacacacagagactgagagacagagagagaagagagaatgggagacacacacacacacacacagagacacacacacagcgtcatacagaagaggcattgaaacacacaccaccaggcaacccctga

SEQ ID NO: 6479 - DNA, 2955 bp, Homo sapiens
cttagccgccattgccgggcctgcctggccaccctgcgcagcggccttgcgtcctctcccggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcatctctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaagaaatgccttcagatgctgttgtcagtgcggagtcagaggtggcggtgtcctctggggtgcgggaggacagattccagagtcttaaccaacctgctcccacagcccgagcagacagccttttgtctccagggctcctgccaccaacaggccccgctgcgactgagatgtgactcaagcagtcaacagagcagtgggactcttttcgtctggcagagaagattgcacactcgggctgcaggaagctgactcaacaactccctctgacccagtgcaggcctgtacggacagggacagggattgggattaacaccagcccaggcccccaccacaccccatcatcatccaggagcacatgtcgcccacagacttcggctgcctttgaagtcagggttgtgaggggtcgagtcacttgggctttttgcgtctctcccaggttacggttaatacctccctttgctaagcgagagccagcaaattagaagcaattttgctggaatatcaactccagaggcccagaagcagtctgagttcagcgaaaggagagaaggcagttcctagatgggaggcactgtggtgtccttcatggggcgacgttaggggcgatggacttaggagccaatcccaggaagagtacagagcgcagacagagcctcagaagacaaaagtgcttctggagcaggcacatgtggggttggaggcacaggggtgccctggaggagcggctcaccagggaggaaacgatggtgatgccagtcctgcctctgcaccaggaactttctacgtgtattccattccttttttgtttttgtaaactttccttcttagagccattttaggttcacagcaaaactgagtgaaaaggtcagagttcctgtgtgccccctgccagcccccagcttcccatctgttgctgtcaatgaaccagtatcggtgctcacatgaggcttcagtttgctgttggacgttcagtgggtttggacaaaaatgtgtaatgatggatccactgcaggatcatacacacttcactctttagacttgctatggaaaattgcaaacatctccaggagacagactagcatacaatcggcccttcatatccatgggggttccatgtccacagattcaaccaaccacagattggaaatacttgg

SEQ ID NO: 6480 - DNA, 893 bp, Homo sapiens
cacactctgcctttggacgtgagagagagcgcacctttcacttgagcttcaacatgggaaagggaaatgaagactccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaagcaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactgctgtgcacaacagtgaaatccaggagacctgtgatgcccaccataggggacattccagggcttgcactgggcacagcaagcggcataggtctcgggccctaggagtccaaacaccgtcaattcgaaaaagcttggtgacttctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtga

SEQ ID NO: 6481 - DNA, 2062 bp, Homo sapiens
cctttggacatgtgagagagcgcacctttcacttgagcttcaacatgggaaagggaaatgaagaccccgatctccactgttcctccatccagtgctccactgaccagccccctttccaacagatctcctttacagaaaagggctcagatgagaagaaaccattcaaaggaaaaggcaagaccgccttctcccattccagtgagaagcacacacaaaggcaagcaggatcagatcccaatccaaacaaggagaattctgaggaaaccaagctcaaggccgggaacagcactgctggatcagaaccagagtccagctcatatcaggaaaactgcaggaaaagaaaaatcagttccaaggatatctgccaagacagagcagggaactgtccagaagaggagtgcaacttgacgttgaataaaaaatcaagatcctccactgctgtgcacaacagtgaaatccaggagacctgtgatgcccaccataggggaagttccagggcttgcactgggcgcagcaagcggcataggtctcgggccctagaagtccaaacaccgtcacttcgaaaaagcttggtgacctctgtgcgagctatgtcggaggctgtttatcaagacctagcccaggtgtgggcacagcagatccattctccactgacctgtgagcagctgacactgctcactcggctccgggggcctctgtgtgcccaggtgcagaccttgtattccatggccactcaggcagcttatgtcttccctgctgagagctggcttgtcccagccacactgcctggtcctggggattcagccctggatagagaagcccatcccttccctgggcaggagataactgagcctgtcagtggatcagatgaggctaagctgggagcaccctgaccctattcagcagagatgcagctctgggaatgagaacaaggacctgcttcttctcagattcttccagacgaccagcagtgacaattttagatgcactgtgttaataaatgacagaacctgaagaagtcataggaaagaaacttgagcggtatactcagaatggtgagccctgaattttgcagaccgctaaggctatagacaaattttatatttcatgttagacatttgataccttttggatgtctgatgacagtcgtgcatttctatataatcagaaaaatattaggttgcaatcgtgaattttcatattttagattgtagaaaagtaaatataaaattatatgctctttttttttttgagacagtcttgctatgtcactcaggctggagtgcagtggcacaatcttagctcactgcaacctctgcttcctgggttcaaacaattctcatgcctcagcctcccaagtagctgggactacaggcatgtaccgccatgcctggctaatgtttttttcttgtattgttagtagagttttgtcacgttggccaggttggcctcggactcaagtgatccaccagcctccacctcccgacgtggtggggttacaggcatgagccgctttaccaagaaattgcttctcttttaattcggaaaaggttgtaggctcttccagcctgaacccatggagtactaacatccacaaaccattaatagcactccctgtgggaaaatgtttatacatttttacagtttgcatagtaaaattactatgcaagctgtttacttttaatatttctacataaaatttaagtcaagatatattaaatggtaaatgattgtacttatttattcatctgcctcatgttttatttcattttaaacatcctgaatttatattttattgtatttcatacatttcaattgattgtactgtattgcaggatatggagatttcatcacatactacaatacagtgtattttgttatatttgacgtatattctacttgtattttgtactgagatcatacaatctttcattatctaagtgtattaatgacttgtttggttgctttataattttcattttatgtaataatgaaataaacattaatgttgtttggaattttaaatttctttcatatggaatttgtatttaataaagatgtg

SEQ ID NO: 6482 - DNA, 903 bp, Homo sapiens
atggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatga

SEQ ID NO: 6483 - DNA, 2727 bp, Homo sapiens
ggacgtcgcttccggagcagcatggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgtcctatgacaatggactggcacagggagctggacttgaatctcatggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaagcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagttttgtgctatgtgggtcatttatctagacattgctgtggtgaataccagttatgtttgattttattctcaaatcattagttgcctttttttttttttttttttttttgctttctaggaagaaaacaatcttttttatctagaaggaaagatactttgtgttttcatttttagccatttgaagtttttaatttattgcccccagtgtgttagctgctctaatttcaaactaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccgttacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacaga

SEQ ID NO: 6484 - DNA, 1566 bp, Homo sapiens
gggaagactacgcagcctggagccgggctggggaggccggcgggggctgcgccagcatgaggcggggttaggggctaggcgggggcgaagccgagactggagttcacggctgggccgagggctcggccgggctgaggctcagggttggacttcacgcaagagtcctgtagagacgaagacctgggcggagagcgatgtgggtcaggacgacgctcacaattgaaagatggactaaggaaaagaccgagcccaaggcccgctcgtgggatgagagcagatgccgcggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctgtggctggccctctgctgctgttctctccctccaacctggctgtttcttgcggggcaaggggtgggctcagggctgcaggggtttctcaaaggcaatccagctttcacaaaggaagcccatgggaaggcaggtgggagggaaaggaaggggcacagccctatttcttcctacctgctaggacaaggtggaagagtgtatctggggtgggaaggagggcttcccctctctgctgcgagagactggtctgtgtgaaatccacttctgggacaggcagtactgtctgcagcgatacccccaataaacggaactttttaaccca

SEQ ID NO: 6485 - DNA, 1137 bp, Homo sapiens
atgtgggtcaggacgacgctcacaattgaaagatggactaaggaaaagaccgagcccaaggcccgctcgtgggatgaggctctctcagatgtaaacaggttacccagctgggagagaggacatctgctggctggtgtggcgtccagcactgatgtgtctaccttctctgaagcaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctg

SEQ ID NO: 6486 - DNA, 533 bp, Homo sapiens
ctggtgcccacccccagtgcctcgaggtcgaggagagctcctcggccccgcaggacggggaggattctgtacagatgagcataacttatgtaaacaggttacccagctgggagagaggacatctgctggctggtgtggcgtccagcactgatgtgtctaccttctctgaaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggag

SEQ ID NO: 6487 - DNA, 1439 bp, Homo sapiens
tttccaaggagacgcgggcgcactgcccctcccttgcttcctcctcttccctccttcctctcctagtttcttccctcccttcccgccctactccttccctcccttcccaccctactcctttcggctgctctggtgcccacccccagtgcctcgaggtcgaggagagctcctcggccccgcaggacggggaggattctgtacagatgagcataacttatgtaaacaggttacccagctgggagagaggacatctgctggctggtgtggcgtccagcactgatgtgtctaccttctctgaaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctgtggctggccctctgctgctgttctctccctccaacctggctgtttcttgcggggcaaggggtgggctcagggctgcaggggtttctcaaaggcaatccagctttcacaaaggaagcccatgggaaggcaggtgggagggaaaggaaggggcacagccctatttcttcctacctgcta

SEQ ID NO: 6488 - DNA, 303 bp, Homo sapiens
atgggcatatctgaagaaggaaacttgctcagcaccgtgagccccacagtgaaagcactttttggcaagactagagtctcaccgattttccctttctctcctcgatctcctttccagcctcttattccccggactcctggctcaccctggggccccgtgggtccagcttctcctttgggaccaggctttccaatagggcccatggggcccggtaaaccagttgggcccaaaggcccaatgttgccccttggcccctcaggaccagtgggacccacgtcacccttattccccttctgcccctga

SEQ ID NO: 6489 - DNA, 569 bp, Homo sapiens
agccactgccgcagaggagccaggcccagcctcggtgagcacacacgccctccctgtctctcgccttcgcttccctgcatctgcgctgattgtgctggagaagaaatacatccacccaccctcctttgatgatgtccactgagcaaatgcagccactggaactctcagaagacagactggacaagctagaccctcgttgcagccacttaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttct

SEQ ID NO: 6490 - DNA, 3421 bp, Homo sapiens
cgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataaaa

SEQ ID NO: 6491 - DNA, 2268 bp, Homo sapiens
gtaagtagatatgtgtgaagtctctagaagagtgtctggcattttggtagccttacataaatgttagcagtagctacccttctcttcctcctcatgatagtactttgagaagcagcaatagtgattgaaagtactctggatttaaacttaaatagctttgagagtcgaaattagctgtggcctctcttgggcatatcacttaacttcttgtgcctcagtttccatatttacaaaatcaggccaaaaaaaatctatcgcatgggaattcaatgatgtagctggtttgtctgaatttctctggtgtgcacaccggaaactcaaagcacgactctatactgtacttttgtaatgtacaatgattgccgtggagagcagcgatggagatgttagtcctctttccttctccatcccccttgccctggtgcctgtgaaacagagcatccccatggcaacagcagcagctggtccctagataagaggagctggagccggccagcagcagccactgccgcagaggagccaggcccagcctcggtgagcacacacgccctccctgtctctcgccttcgcttccctgcatctgcgctgattgtgctggagaagaaatacatccacccaccctcctttgatgatgtccactgagcaaatgcagccactggaactctcagaagacagactggacaagctagaccctcgttgcagccacttagatgatctttcagaccagttcattaaggactgtgatctcaaaaagaagcctagaaagggaaaaaatgtacaggccaccctgaatgttgagtcagaccaaaaaaaaccaaggaggaaagatacaccggcgctgcacatcccacctttcataccaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttctccccaggagatgtatgccatcaaattgccagtcacctctttgtctctctcttctttctgagtatggtttctattctgtgttttgaatttttattttctaatgcagtggaaaagaaacagatcatcctaaatgaggaggtaacagggaaagcactggggttcggtttctgcatcttctggatcaattcacggaacagagatcgtggattacatgggctccttcttggtttttgctgctgggcaggacttgacttagcattatccaagcaccagtccaagtggggttccctgttgccagttagagaggtgagaatgtttggactctaactcaccgattgctttgcagacaaaggtcttttatttctcctgtcctatcttaagagtccaaatgtctctggtgatgttcctaagacccttgtcccagatactctaaatgtgaatgtatgagctgggggagtcaacccagcccaccatgccttggctgatgataccagaggcagagagtgctggtctgtctgggaagcttagcaatgtatcttcaaatttatttttgtttttaaaaatatttcttaaacatgctgtcccaacatttgtgagttgtgtcacaagtgagtcattatcaatggtagataaaatatcaatgtttgtgatgaatttactgtaaaaaaattaaggtcaatgaaagccattctgttatttttagcattctcacttatttagactctattacactttcttggatgagaggggagagtgtggtgttagctagtgagcagaggtctgtatattgtccttgccccagcctgcaatctgtggatgcccaggggaaggcatacaggcctcatccaccaggcaatagacaggagagaggtgagaactatttttagaaggaggaaaagtagatacgcaaattgtcacaactaagagtgataatttggtagctctgtatgtatgctggttccaactgtttaatcccttctgtctttctgttctcacaaagatggaaaagatacaagagcttgccggaaataaagctacatctatcca

SEQ ID NO: 6492 - DNA, 2853 bp, Homo sapiens
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtggactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 6493 - DNA, 4599 bp, Homo sapiens
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtggactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 6494 - DNA, 4599 bp, Homo sapiens
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccaggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 6495 - DNA, 1111 bp, Homo sapiens
cttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 6496 - DNA, 2853 bp, Homo sapiens
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccaggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 6497 - DNA, 1111 bp, Homo sapiens; identical to SEQ ID NO: 6495

SEQ ID NO: 6498 - DNA, 1134 bp, Homo sapiens
atggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgataatgagcctggcagggaagggcaaccaacatcttgtaacttgctttccccaccctgtttctgggggcagagccaattgcccaatttctaccctaatccaaagtccctggtgtgggtggggttaa

SEQ ID NO: 6499 - DNA, 1134 bp, Homo sapiens
atggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtggactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgataatgagcctggcagggaagggcaaccaacatcttgtaacttgctttccccaccctgtttctgggggcagagccaattgcccaatttctaccctaatccaaagtccctggtgtgggtggggttaa

SEQ ID NO: 6500 - DNA, 3137 bp, Homo sapiens
ccaccttcctcccaccccgggaacccggaagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctagttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcaca

SEQ ID NO: 6501 - DNA, 3142 bp, Homo sapiens
aagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcaca

SEQ ID NO: 6502 - DNA, 2378 bp, Homo sapiens
tactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaaggttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctagttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcaggg

SEQ ID NO: 6503 - DNA, 799 bp, Homo sapiens
cgacaggagccctcaagctgatctggtcgggaccggatacattattaaccccagtgcagtagggtccccaggggcaacctgccccacagcgcccaagatgcctagcagaactgcccgctatgcccgctacagcccacggcagcggcggcggcggatgctggctgatcgcagcgtgcgtttccctaatgatgtcctgttcttggaccacatccggcagggtgacctggagcaggtggggcgcttcatccggactcggaaagtctccctggccaccatccacccctcaggcctggccgccttgcatgaagccgtgctctctggaaacctggaatgcgtgaagctgctggtcaaatacggggctgacattcaccagcgagatgaggcgggctggacacccctgcacattgcctgcagcgatgggtaccctgacatagccaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtgg

SEQ ID NO: 6504 - DNA, 1535 bp, Homo sapiens
gtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagagaa

SEQ ID NO: 6505 - DNA, 1472 bp, Homo sapiens
gtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcaga

SEQ ID NO: 6506 - DNA, 1031 bp, Homo sapiens
ggaaatgacgcctgggagcgacaacagggtgggtggggctgctgactccgcccccgaaggaaagggttaacggtttccggtagcggcgtctaggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgaggggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaa

SEQ ID NO: 6507 - DNA, 1405 bp, Homo sapiens
agcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaaggtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatctcaagtaaactactttgacttt

SEQ ID NO: 6508 - DNA, 3158 bp, Homo sapiens
gcagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcgccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctggtgaccctggtgctgtggaacaaccagctcacgcacacaggcatggccttcctgggcatgacactgccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtgacactttagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcacagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttca

SEQ ID NO: 6509 - DNA, 2430 bp, Homo sapiens
ctgcagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcgccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctggtgaccctggtgctgtggaacaaccagctcacgcacacaggcatggccttcctgggcatgacactgagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtga

SEQ ID NO: 6510 - DNA, 5548 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaa

SEQ ID NO: 6511 - DNA, 2334 bp, Homo sapiens
aaagttaaagggggcagcgcggccgcggggagctcgagtcccgggtgactgctggagggaggaggtgaccgcgcagctctcgtgcacggacggacttcgccgcccgcggggggcgcgaacccgagcccgggcccagctcctgccgtcacggcagctgtccctgttcccccagggcgtatgctgccgcgggctggcgcgtctgccctcgggacttatgagctgaacccgcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaac

SEQ ID NO: 6512 - DNA, 1084 bp, Homo sapiens
gggacccggcgccgatgaaaccgaccaaactggagttagctaccggactgtcccgcgagcgaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggtacatatttatattaatataatttttaagagaatgacacctagttaactttttggttattttaccagcaagctttcagaaatataaatctgacatctggatctgtgaaaattgtcaactttaaattcaatattttgaataagagcaaaagttaaaattgacaaataaagcatgaaaaacatctgctgttcagaagtaattaaagcacctgatacttattccttaaggaggatattttgctattaccaataaaaatggttagtcataaa

SEQ ID NO: 6513 - DNA, 1213 bp, Homo sapiens
gggacccggcgccgatgaaaccgaccaaactggagttagctaccggactgtcccgcgagcgaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatgaattggaaagcatccaaagatgccaagaaaatcagcaaaaaaaggagcagtaaaaatgaggatgcaagcaattcactcataagtaacttcaaaacaatgcatcatatagttcctgtttattacccacaggtgggtaagccaaaattagcctttttctctgaaatacagagataccctgtaaatgcaaatgcatctccagaaagttcctgtcctttttggccaaacatagaaagaaagaatctctctttgaagcaatctgaaagcttgctgacaaaaaatgatgtgcatgaacctcacctcttccataacccagaagaaaaagaaaatttgtttgtggaaaatgagtaa

SEQ ID NO: 6514 - DNA, 1282 bp, Homo sapiens
ggctgtactttgcattttgaagagtctaagaatacattccatatcttcaaatattttattgtgggcaatttataataacatagcctgggtaatgccaatgtaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatgaattggaaagcatccaaagatgccaagaaaatcagcaaaaaaaggagcagtaaaaatgaggatgcaagcaattcactcataagtaacttcaaaacaatgcatcatatagttcctgtttattacccacaggtgggtaagccaaaattagcctttttctctgaaatacagagataccctgtaaatgcaaatgcatctccagaaagttcctgagaagattacactaaaattatttaagagatggggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaa

SEQ ID NO: 6515 - DNA, 1782 bp, Homo sapiens
tcttcacgcgccgcattcgtagcccgagagtccgcgccgcggggaggcttggaggcaagcgctgcccgcgagctgagccgccggaggaggagccgcgggcaacgagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcag

SEQ ID NO: 6516 - DNA, 6795 bp, Homo sapiens
aggaggaggaggaggaggagaaggaggtaggggcctgcgggtggctgggcggggcgcgctcgggcctccgctcttcacgcgccgcattcgtagcccgagagtccgcgccgcggggaggcttggaggcaagcgctgcccgcgagctgagccgccggaggaggagccgcgggcaacgaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatat

SEQ ID NO: 6517 - DNA, 2196 bp, Homo sapiens
ctttcccagaaggctccatattctcaacatgtgcaggtcaatttgacataaagctaccaacaaggagcaacaggcccactgcaggctgtgtttataacttgaaaattatgagcaggtattgggagccacagactgtatttgggaaccagctgcatgtcaggacaagcatagattgtggtctgtggaggctgggagagcacaatgcttgaatttcatttctttgggagataagaagaaaaaataccttcctacctgacaagattgacaacttgctaaatctgattatcttcagaagtgtgctggacagttgcgaagtaaacatttacttttcaaagatgatgatcaaggaaacatctctacgaagggacccggatttaaggggagagctagctttcctggcaaggggctgtgattttgttctcccttcacggtttaagaagcggctgaagtcatttcagcagacacagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaa

SEQ ID NO: 6518 - DNA, 804 bp, Homo sapiens
aaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaagtaatgaagacttggcaaaattagcagtccatgatggatatacaaacatttttttattctaaaatgaacagtcatcatcacagtcagtgttgatatttattgaacacctgatgcctgcctgggctctcagtagaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccagggt

SEQ ID NO: 6519 - DNA, 2151 bp, Homo sapiens
attgcttcacagtccttctgaatcataaagtgagttctgactgaggttccaggtgatgtagtgaacattccacacagggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaggtaattccaaaggaacatgagcaccaataatgctttaagagtgttttggaaatcaagagaatggaatatgaaaacatcaacatttgattcagatgaggatattctacttttacccaaaagaaaacgttttagaaagaaaaagtcaagaccagtgagacacaccaaacgccatgaagaggagcaggtctatgagcaagggaccacattaccctgttccatatgcaagcacgaaattgacctaactggtatttttctccataagaagcaacatgtagctctggccacgctgggtttccaatggatgggtagaaagaaaccacagccctcagtgattgctgttcagagacagttcatgatttctaaactattgtcatcttttatgttcactgaaaaaaccctacagagcattaataatgcttttgagctgctttggaaaaaacaaataccagcatactataagatttttgataacattgacaggagtgtcatatattctcaaaaaatatgtcatctgttaattaaaggagtgggcatttgtgaagacaggaattctacatggaaagctgacatgaatgataaattcactgtagtgagtaattttggtaacaaacctaatgtgtgtttttttggtttgtttgatggacatcacggtgcctcagcggcagagttgacatcaatggaactcccagttttacttctccatcagctttccaaatttgatccttcttaccaaatgacaactgatgagcaacaaataatcaattccttttacactgtgtttagagaagaatacgcagcaatagaagacctcttttctgccataaacaaaacagaagcagtgaggtgtgagtatgaggacacacacaaagcctttgcaaaagcattttggagaatggataggcttttaggtcttggaagaaaagaagtgtccagggttcaatggagtggctgctctgcagttacttgtatattggaaggcaaacctaaaagtccttatgctcataagaattggaaaagaaaaaatacccatgatgggttggcagagagctccccttcccaggagatgccaaaaataatttctggaatattacatgttgcaaacactggtaatgtgcaagcagtcttatgcagaaatgggaaaggtttttgcctaaccaaagaacatactacacgaaacacaaatgaaagaagaagaatacttcagaatggagcagtcattagttcaaatgaaccatacgggcttgtagaggggcaagtaaaaactacacgaggacttggatttcatggaaatctcaagctgaaaaaatccattatcccagcacctcaaactatttctgtccctatagatgacctatgtcaattccttattgtagctactaatggactttgggaagttttggataaagaggaagttactgccctggcaatgacaacatttcacatgtataaagaaacatactgtcctatcatacctaacaaatcaccatccaaagggcctctgcttttttcaaccagtgaaccaaaccttactaaatcacagagtaatatccacgtattgtttcagtataaatctgtatctgaagtacgtgtgtcaactacaaattccaaagaaaatttatccgattcaaactattctaaatactgtatttataaccctgagaatgtagaaacatttccagcagaaacgactcatcgtaaaccttgcagtgaaaaagtaactgacagaccaactagtgtaaatgatgtggcaacaaatgaaaaagaatcagacactaagagtttctatgaaggcgcagctgagtatgttagccatgaacttgtaaatgctgctttactggctggctccagagacaacattacagttatggtaatatttctcaatggaagtgaatatcagcttctgacataa

SEQ ID NO: 6520 - DNA, 2541 bp, Homo sapiens
atgcccatcccaagatggcggagatccccctgtactttgtggacttgcaggatgacttagacgactatggatttgaagactatggtacagattgcgacaacatgagagtaacggccttcttggacattccaggccaggataacctgcctccactcactcgcctggagaagtatgctttcagcgagaacaccttcaaccggcagattattgccagagggctgcttgatatcttccgggacttcggtaacaatgaagaagacttcctcacggtaatggagattgtagtcagattgtcagaagatgcagagcccacagtgcggactgagctgatggaacagattcctcctattgccatttttttacaagaaaacagatcaaattttccagtggtgctctctgaatatctcatacctattgtagtgaggtacctcacagatccaaacaatcagataatctgcaaaatggcttcaatgctgagtaagagtaccgttgaacgcctgctactcccccgattctgtgaactgtgtggtgacaggaagctctttcaagttcggaaggtttgtgctgcaaattttggtgatatttgtcatgctgttggacaagaagccactgagaaatttttgatcccaaagttctttgagctctgctctgatgctgtttggggcatgcggaaagcctgtgcagaatgcttcacggctgtgtcgcacagctcctcccctggggtccgcagaacccagctcttcccgctcttcatcagacttgtcagcgacccctgccgatgggtgcaccaggctgccttccagtccctcggccccttcacttccacctttgcaaacccctccagggctggcctttatcttcgagaggatggcgccctgagcatctggccactcacccaggatttggactctggttttgcctctggctcccctgctcccagcagtggtggtaacacttcccctgccagtttaactcgttcagcaaagcctgtgcggagcgagccagagctacctgtggaagggacctcagcgaaaaccagtgattgcccacacagcagtagctcctctgacggcccagcggaaagccctgtggaaagctgtgtgtcggctggagctgagtggaccagggtttccccagagaccagcgcctgctcaaagctttctgacatgaatgacctccccatcagcagctaccctggatcagattcctgggcctgcccagggaacactgaggatgtgttcagtcattttctttattggtgaactcctctccctgacataagcaaggacttagagctgcttctgagtgaggctgggcctcaggaggacgactgcagcagacctggggttgtgcacaacagctgtgtggcccggagtgagattcagaaagtccttggtagcttgcaggagcatctgatgaatgatccagatgttcaagctcaagttcaggtattatccgctgcactgagagctgcacagctcgactgcgtgaatgaagctgagagcaagccaacagcaggcctaaaggaagtgtccatttcacatcccagctctgcctctgacaatcagatcgctctggcggcctcatcatctcaggatgagctctttgtggccaggatattacaaagcccagatccaggtggacccagaaatggaaccagtgaccatctggagactgaccagaggcaggatcccaccccacttgaagagaataaatctaaattacaggatgtaatacctcagccgctgctagatcagtatgtgtccatgactgacccagctcgagcccagactgtcgatactgacatagccaaacactgtgcctacagcctcccaggggtggcactgaccctgggcaggcaaaattggcactgcctgaaagatacatatgaaacactggcttctgatgtacagtggaaggtacggcgagccctagccttctccattcacgagctggctgtgattcttggggatcagttaacagcagctgacctggtgcctatcttcaatggatttttaaaggatctggatgaagtgcgaataggagttcttagacacctgtatgattttctaaagttgcttcatgaagacaagaggagagactatctttatcagcttcaagaatttgtagtgactgataacagcaggaattggaggtttcgatatgaactagcagaacagctgatactgattctggaactctatagtcccaatgatgtttatgattacctaatgcacattgccttaaagttgtgtgcagatcaagtttctgaagttcggtggatctccttcaaactagtcgtggcaattctgcagaagttctattccaacagtgaaagtgcattggggttaaatttcatcaatgagctcatcataaggttccggcactgttctaaattctgaaatgacttctttgggattaaagaagtgtatgtttctagaagactgcggaaaacatcatttctttggctgtgactttcttggagcaggcagtggtgagcaaggagtgtgtccccgtggaccagttcatggagcacctgct

SEQ ID NO: 6521 - DNA, 5143 bp, Homo sapiens
ggacacggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 6522 - DNA, 1778 bp, Homo sapiens
ggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggtgagagccaaagaggccgacccaagtgggagaaggtctctcggaagcccaggcctcgagtgtggcccgcggctcaccaggggttcagggaggcagtgtgatgggccgagggggatttgtcatgcactggggtgataccctcgtagtgtgaagggaacagggcagattcagagactgcagcaccagtgtctgagtgtaagttacactgtatgttattatctcacctaaaacagctcctacaaatctcatagaaacctgtggctcaccaccctatgggctggaagtagagcttccaatattccggaaatgaggtttatcctcctcccgcgttcatgctgacaatccttttttctcttttgggaaaaaagtgggttcgctgggcgcggtggctcacgcctgtaatcccagcactttgggaggccgaggtgggtggatcacctgaggtcgggagttcgagaccagcctgatgaaaccccatgtctactaaaaaaaaaatacaaaaaattagccaggcatggtagtgagcccctgtaattccagctattcagaaggctgaggcaggagaatcacttgaacccagaaggcggaggttgcagtgagctgagatcgcgccactccactccagcctggataacgaggaaaactctgtctcaaaaaataataataaaaataaataaaaattttaaaaagtaa

SEQ ID NO: 6523 - DNA, 5245 bp, Homo sapiens
tccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctg

SEQ ID NO: 6524 - DNA, 5587 bp, Homo sapiens
tccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctg

SEQ ID NO: 6525 - DNA, 1634 bp, Homo sapiens
attactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctatta

SEQ ID NO: 6526 - DNA, 5748 bp, Homo sapiens
gctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgtttgttcccaagttgcattttctaaccgaatcagtgtgttttcatgaaactgagtgtttctgtggaccagtagttcctctgttgtcttcagtggtcttcctgtgtggctcaagggttctctgtgagagtctggattttcatttctggaatggctggccccatcccacttttctgtatcatggggacacatataaagcagtgtttaatagagcagtttaagaagttgcttgcatctgttggttcaccatggctcatctggggaccattttggattcatgtttcatggcttgtgactgtccccaagcccactccaaacaaagtgtaaggatcagagttctgtcaaggagcagcagttctgctctccccatcatctttgtgcaaggcccctcggggggcactttaataaaagaatttgaaatgggttgactggccattctcatgctgtgctccctgtctcttctcttctctaaagaatcatgtcccagctcctcaaggtccctctatggttccacatctgagtgttcgccacaagagcagcagcagcaggcacagtgcatgccatatctacctgctgcttctctgctgggaggaatggccaagtagattataaaactcacttctgtctcttaggcagacttgtacggccacaaaattacctagtcttcttcctgctgagctactgaggtattgccaccattttgacaactttgagtaattaaaacactcttctgacccaaaaaggaaaaaaggtcactgacgtgacccccccagcatgctagagagctaattccagttctcatatttgtttgaatttcttcccagaggagaggataggaacctctcctccagggcagtaaatcacctgcatttctggagttgtcggtattgtattcgaaaaggcctggagcccctcctgctcaggaaagaactcattccagggtgtggagacagtgccgtctggcaggtgaaatactgtgggaattcacgccaccaggtgtttgtgcaagtgttggcctgggaagaatgggacttcggccttgtcaggagttgtcttcatctgcagcacgtttcttcctcctgcagtagatcttagctaccccagatatctctatggagagaagtttgtggaaaatgctttgcttcgtggcagagtctgatgctgtaggaaaaccttcgggcatgtgacagcagtgtggtccactccctgttctgccctggcactcagagtcatgtgtaagtaggaaacctgagcaagtcttccgtggaggaccctgagctgccgtctttgggatccttcctgtgtccccaccgtctttcatttatttgctttcctgggcctctatctgggccctaccttgagcttctccagttttattcaagccaccagagtaagaatttgggtgtagatgtcacaactaccttctactcaattcaccaattcatttactgctatggcacgtctcaggaataactctagaaacctctaaatcgaaatattataaaatcttgagcacttagtcctgctggttttagttagaaaggcatccaggaattgttttcctacgcccccttgagtggaaagatcttagttagaagataaagtcaagtttgtgttcaggggatgggaggaagactataaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgtgtctacataacgggttggcccctggtgcatccctggaaaagtcaaaggacgcacacttcgaaattctgcagaacgtatttatacatggttcagaaatcttgcgtatctgacttatagccaaatctgcttgctcgaatagcctcagaggaagtcttgtttaataaaaaccttttgatttcctagtcaagtctttatggttgtctcgaggggtgtgtggctactttaatgaaaggctttcctgctctaaatctctttgctgggctgggcctcttcagactatctggtgaaactcctttccttagaacaaactcagtccgtccatgctctgtggcattttgctagatgataaccaaagccttattcctgtagccagtgtcagcagtcagagaggtggagggtgtgttctgctgtggttatgcatacctatctgctgttcttgaggtgtaaaaggaaaggtgaaaatcgggccaggccaagtactcagctgtcttaataggatgaagccttaagcagtggaaatttcagttattttccacagtattccattttggaggatttggggtgtttactttttaaattcttgaacaacttaacctccatgaggctttgtgaagtcagctgtgaccaccctcctcttactgtgttctcagtattcattcacttccagggaagaatgacagccacagggagatggtggtgggcaagaatgagagtcccaggatccagatttagcctcagatcttccccattcaggaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggag

SEQ ID NO: 6527 - DNA, 1919 bp, Homo sapiens
gttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgccctggcgggactggtggcttcacgcctccgcttgggcctggccccagagcttctctgcgcgcagctgttggacacgtgtctgtgcaaggtcctgggggcgtggcgtggtacctttggggcttggtgcagcagagggagagagcctcggggttttggggaggagggctttgatagagaggcaagagtaaagctagcaaaggaggggataggactcaagcgaagggcgtggcctgaagtgggcagggccaaaatacaggggcggagcctgagggatgctttgaggcacgggagagttagtggaagggacttaagagaaagggcgtggtcttttggaaaggggcgattctgggtcgtaggagccgggccggaagtattgattagtgctggaaggtggaagagcaggtaaacatcagagcgggcggagctttagggaaaaggcattgttctctcaattgggagcgcctaggaccgggtttggtcccagtaagagaggattggcaggtgggtgggacgcgaaagaaatgggcataagtagaatgaagtgggggacttgaacctggggattgttgggaagctctgccttggactctcccccaccgggctcctttttctccaccggcttcagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcg

SEQ ID NO: 6528 - DNA, 1712 bp, Homo sapiens
atggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgccctggcgggactggtggcttcacgcctccgcttgggcctggccccagagcttctctgcgcgcagctgttggacacgtgtctgtgcaagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgt

SEQ ID NO: 6529 - DNA, 1417 bp, Homo sapiens
caacatggccgagaccagcgaggaggtggcggtgctggtgcagcgggttgtgaaggacatcactaacgccttcaggaggaacccacacatagatgaaattggcctgatcccatgtcctgaagctaggtataaccggagtcccatagtcctggttgaaaacaaactgggtgtggagagctggtgtgtcaagttccttttaccatatgtccacaacaagctccttttgtacagaacaagaaagcaatggctgaacagagatgaattgatagatgtcacatgtaccctgctgcttctaaacccagactttaccactgcatggaacgtgaggaaagagctgatcctctctggcactttaaatccaattaaggatttacatctgggaaaactcgccttaaccaagtttccaaagagtccagaaacatggattcacaggcgatgggtgctacaacagctaattcaggaaacctccttgccttcctttgtgaccaaaggaaacttgggaacaattcccacagaaagggcacagcgactcatacaagaagagatggaggtctgtggtgaagcagcagggagatacccaagcaactataatgcttggtcccatcgcatctgggttttacagcacttggccaagctagatgtcaagattcttcttgatgaactatcttctactaaacattgggcatctatgcacgtttcagaccacagtggatttcactaccgccagtttttgcttaagtctttgattagccaaactgtgatagacagttctgtgatggagcaaaatcctttgagaagtgagccagccctagttcctccaaaagatgaagaagcagcagtttcaacagaagaaccaaggattaatcttccccatcttctagaagaagaagttgaattcagcactgatcttattgattcctacccaggacatgaaaccctttggtgtcataggcggcatattttctaccttcagcatcacttaaatgcaggctcccagctgtctcaagcaatggaagtagatggactgaatgactctagcaagcaaggctattcccaggaaaccaaacgcctgaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttcc

SEQ ID NO: 6530 - DNA, 1322 bp, Homo sapiens
tgataaagggcggaggaacggggctggctgcttcccgagtccccaggtcccgcgagcggcgggcgtgttgcgggtatggggtgcggcgccagcaggaaggtggtcccggggccaccagcgctggcttgggccaagcacgaaggtcaaaaccaagccggcgtcggaggcgcggggcctgggcccgaggcggcggcccaggcggcgcagaggatacaggtggctcgcttccgagccaagttcgacccccgggtccttgccagatatgacatcaaagctcttattgggacaggcagtttcagcagggttgtcagggtagagcagaagaccaccaagaaaccttttgcaataaaagtgatggaaaccagagagagggaaggtagagaagcgtgcgtgtctgagctgagcgtcctgcggcgggttagccatcgttacattgtccagctcatggagatctttgagactgaggatcaagtttacatggtaatggagctggctaccggaggggagctctttgatcgactcattgctcagggatcctttacagagcgggatgccgtcaggatcctccagatggttgctgatgggattaggtatttgcatgcgctgcagataactcataggaatctaaagcctgaaaacctcttatactatcatccaggtgaagagtcgaaaattttaattacagattttggtttggcatactccgggaaaaaaagtggtgactggacaatgaagacactctgtgggaccccagagtacatagctcctgaggttttgctaaggaagccttataccagtgcagtggacatgtgggctcttggtgtgatcacatatgctttacttagcggattcctgccttttgatgatgaaagccagacaaggctttacaggaagattctgaaaggcaaatataattatacaggagagccttggccaagcatttcccacttggcgaaggactttatagacaaactactgattttggaggctggtcatcgcatgtcagctggccaggccctggaccatccctgggtgatcaccatggctgcagggtcttccatgaagaatctccagagggccatatcccgaaacctcatgcagagggcctctccccactctcagagtcctggatctgcacagtcttctaagtcacattattctcacaaatccaggcatatgtggagcaagagaaacttaaggatagtagaatcgccactgtctgcgcttttgtaagcagatgacctctaaaactatttttgcctattttaggaccatttcatcatgattagggcaccctcaagctccaaagacacgggactcca

SEQ ID NO: 6531 - DNA, 4517 bp, Homo sapiens
gggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataa

SEQ ID NO: 6532 - DNA, 4398 bp, Homo sapiens
agtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccat

SEQ ID NO: 6533 - DNA, 2226 bp, Homo sapiens
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 6534 - DNA, 2481 bp, Homo sapiens
gcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 6535 - DNA, 2872 bp, Homo sapiens
tggacccaactggcgaggctgctggggttgcagcgggacagttggggcggccccgcaggcccagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 6536 - DNA, 1137 bp, Homo sapiens
agtttttccccccgcctttgttcagtaaacgattatgagggaaatgactctgaagcagaagacctgaatttcagggaggctttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcggaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcgaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcagtaagtgtgtga

SEQ ID NO: 6537 - DNA, 275 bp, Homo sapiens
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcggaagagacaggtggagcagtgaggatgaggaggctgcagggccatcacaggctctctcccctctactttctg

SEQ ID NO: 6538 - DNA, 530 bp, Homo sapiens
gcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagtctgtaaacgattatgagggaaatgactctgaagcagaagacctgaatttcagggaggctttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcggaagagacaggtggagcagtgaggatgaggaggctgcagggccatcacaggctctctcccctctactttctg

SEQ ID NO: 6539 - DNA, 1332 bp, Homo sapiens
ccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccacccca

SEQ ID NO: 6540 - DNA, 2043 bp, Homo sapiens
atgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaa

SEQ ID NO: 6541 - DNA, 2013 bp, Homo sapiens
ccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcat

SEQ ID NO: 6542 - DNA, 1590 bp, Homo sapiens
agctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctcgctgcccctggcccctctggagctcagcagggagccccatgcccttccaggtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcat

SEQ ID NO: 6543 - DNA, 2278 bp, Homo sapiens
gagactttgctccctgtcgatgccgtggctggacaaatgccgctctcaactgctacagaccaaagtctacgctttaaagatagagaagccattctgtcaaagtgaaaacagaagcggtaggtaggaagccgcccccctttctttcaagcacagagacccagagagacgcccaggagctcccgaaaaaaacgttgctgattagagctgccgggtcagaaacagctgtgagacactaaagtccccactgttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgtttgaagtgagtgtggtctttgctcacccagaaacagttgaggattgccacttcctagctgcgatatgcccagattgttttaagccagccaaaaacaaacagtctgtattcactagaatggcagttatgaaagccttgaataagataaaggaagaggatttccttaagcagtttccttgtcctccaaactcaccaaaggctgtatgcgctgttcttgaaattgaatgtgctcatggtgctgtttttgtggctgggagatataataaatactccaggaatctaccacaaactccttggataattgatggagaaaggaagctggaatcttcagtggaagaattaatttcagatcatctgttggcagtatttaaagcagagagttttaatttttcatcctctggaagagaagatgtagatgtgagaacattaggaaatggaaggccctttgcaattgagctggtgaatcctcatagagtacatttcacttcacaagaaattaaggaacttcagcagaaaattaataactcatctaacaaaatccaagtacgtgacttgcagcttgtcacaagagaggcaataggacatatgaaagaaggtgaagaagaaaagacaaagacctacagtgccttaatttggacaaataaagcgatacagaagaaagacattgaattcctaaatgacataaaggacttaaaaatcgaccagaaaacacctttgcgcgtccttcaccgaaggcccctggctgtgcgagctcgcgtcattcacttcatggagacacagtacgtggatgagcaccacttccgcctccacttgaaaactcaggctggcacctacattaaagagtttgtacatggagacttcgggagaaccaagccaaacattgggtccctgatgaatgtgactgcagacattctggagctggatgttgagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatatgtgtatattttgtgttaaattgttccaaggatgtcttaggatttttctcattccctctttcacccccacaaaccaaactatgaataatgaaataattctccttaattctttcatttagagaggtgcacaaacaggacacattctctgttaacctaagaagctgtaatttcagcaagatttccctccacaagagatataccacctttaaaatcatgttctaatttttgtaaattatctgaataaaagttatatctag

SEQ ID NO: 6544 - DNA, 1820 bp, Homo sapiens
ggggttaaatctcaggctccggcgtctggggagaaggtgaggcggttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgtttgaagtgagtgtggtctttgctcacccagaaacagttgaggattgccacttcctagctgcgatatgcccagattgttttaagccagccaaaaacaaacagtctgtattcactagaatggcagttatgaaagccttgaataagataaaggaagaggatttccttaagcagtttccttgtcctccaaactcaccaaaggctgtatgcgctgttcttgaaattgaatgtgctcatggtgctgtttttgtggctgggagatataataaatactccaggaatctaccacaaactccttggataattgatggagaaaggaagctggaatcttcagtggaagaattaatttcagatcatctgttggcagtatttaaagcagagagttttaatttttcatcctctggaagagaagatgtagatgtgagaacattaggaaatggaaggccctttgcaattgagctggtgaatcctcatagagtacatttcacttcacaagaaattaaggaacttcagcagaaaattaataactcatctaacaaaatccaagtacgtgacttgcagcttgtcacaagagaggcaataggacatatgaaagaaggtgaagaagaaaagacaaagacctacagtgccttaatttggacaaataaagcgatacagaagaaagacattgaattcctaaatgacataaaggacttaaaaatcgaccagaaaacacctttgcgcgtccttcaccgaaggcccctggctgtgcgagctcgcgtcattcacttcatggagacacagtacgtggatgagcaccacttccgcctccacttgaaaactcaggctggcacctacattaaagagtttgtacatggagacttcgggagaaccaagccaaacattgggtccctgatgaatgtgactgcagacattctggagctggatgttgagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatat

SEQ ID NO: 6545 - DNA, 571 bp, Homo sapiens
agtcgggctgggagtaaagccgcacgcactccttcgctcgtgggggaggtagggtgaggtggcaaaccaggcagtttttcggatttcctctacaaacaagaagggagaagctcacttagtcctagcgagagcgggctggtacttttgttctaaaacgcacgtttcctcggggaacagaattgctagacgcaatagttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtg

SEQ ID NO: 6546 - DNA, 3480 bp, Homo sapiens
cgcgtcgctgcgccgcacgtgtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccggccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatcaaaa

SEQ ID NO: 6547 - DNA, 2356 bp, Homo sapiens
cgcgtcgctgcgccgcacgtgtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaag

SEQ ID NO: 6548 - DNA, 2691 bp, Homo sapiens
gtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacgcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctc

SEQ ID NO: 6549 - DNA, 3974 bp, Homo sapiens
aattacgcccctgtcggaggctgaaacacttaaggcttccgggcatgcgcacagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaataca

SEQ ID NO: 6550 - DNA, 4364 bp, Homo sapiens
tgcaaatgaatgccttccactgaaccgaggtagacggggtcgagtttcttgcgcgatggtgggcttgtatgtgtgtgtgtgtgtgtgtgtgtggggggggggggtgacgaggttggcattgaggatccataccctttgcgcccaaagaaaggtgacgtggactagtgtcgtgcctttggacaggcagagtaagaggagggagaagaaacaggtagagctgctggccttgtcggggacacctttggacgtgctggagggcaacgacgccctagttttctgtgaagttaagtagcttctgcaggactgggttcagtatttctagtaccttctcaggatccctcctccgccaacgaattcctcaaccacgggccaagcaaactactcccccgcccactgtcagcagcagtctctgttgaatgggaatactgcaccttcaggcttaacgccacgtgggctcctttgctgtcctccaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaa

SEQ ID NO: 6551 - DNA, 784 bp, Homo sapiens
gtgcaaatgaatgccttccactgaaccgaggtagacggggtcgagtttcttgcgcgatggtgggcttgtgacgtggactagtgtcgtgcctttggacaggcagagtaagaggagggagaagaaacaggtagagctgctggccttgtcggggacacctttggacgtgctggagggcaacgacgccctagttttctgtgaagttaagtagcttctgcaggactgggttcagtatttctagtaccttctcaggatccctcctccgccaacgaattcctcaaccacgggccaagcaaactactcccccgcccactgtcagcagcagtctctgttgaatgggaatactgcaccttcaggcttaacgccacgtgggctcctttgctgtcctccaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagct

SEQ ID NO: 6552 - DNA, 3313 bp, Homo sapiens
atgcgcacagcgttgtgcaaatgaatgccttccactgaaccgaggtagacggggtcgagtttcttgcgcgatggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaa

SEQ ID NO: 6553 - DNA, 1149 bp, Homo sapiens
acagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaatt

SEQ ID NO: 6554 - DNA, 1287 bp, Homo sapiens
gtgaccaggccgcgtccgcgcgcgcgcaggattcctgcgctggaggccgcctctgacgccaccggctgggctccgccatgagttcggcgccggcctcaggctccgtgcgcgcgcgctatcttgtgtacttccagtacgtgggcaccgactttaacggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctgga

SEQ ID NO: 6555 - DNA, 252 bp, Homo sapiens
tgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagagacggggtttcaccatgtttaccatgctga

SEQ ID NO: 6556 - DNA, 1063 bp, Homo sapiens
agagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcggagattctggtacagagaaaggagaggcgctgagtggaaccacgatgggctgaggccaggggagacatcgcaacctccaacaacactttttttcatgctttaataactcatttttcttagagaactaaagtagttgaaacaatatagaaacattttttaagtaggcatat

SEQ ID NO: 6557 - DNA, 1063 bp, Homo sapiens; identical to SEQ ID NO: 6556

SEQ ID NO: 6558 - DNA, 252 bp, Homo sapiens; identical to SEQ ID NO: 6555

SEQ ID NO: 6559 - DNA, 2965 bp, Homo sapiens
aagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaa

SEQ ID NO: 6560 - DNA, 3003 bp, Homo sapiens
gatgggaataggaggaggtggggggtggcatctagggagtgctggaggggccacctggagagcctgcatgtgacctgccctgaaaggaggaaaacagctgcagctccagtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaa

SEQ ID NO: 6561 - DNA, 3557 bp, Homo sapiens
gctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaa

SEQ ID NO: 6562 - DNA, 534 bp, Homo sapiens
attcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagaga

SEQ ID NO: 6563 - DNA, 484 bp, Homo sapiens
actagagggacctccaccccaggttgcgagtgcagcgcggcgggacctgggatgattcgggggctttccgacctgcttagggagggcggctcagagacaacctcaattttgcctggattgcacgcgggccgaggaagtcgggatgctccgaagggtttctgctctgggagtgcctctaattaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttg

SEQ ID NO: 6564 - DNA, 625 bp, Homo sapiens
cagtaggaggaggatgtcgctgctgagactgtgggacagctaggctcagagggagtctgacttcggggcacccggagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttga

SEQ ID NO: 6565 - DNA, 814 bp, Homo sapiens
gggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagactaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttg

SEQ ID NO: 6566 - DNA, 1488 bp, Homo sapiens
agttggtcggtgggccagtggcccgtcgctcgcttctgggctctcatgtttgaaggtgggagggacacgggagcggcccgcacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcgg

SEQ ID NO: 6567 - DNA, 1955 bp, Homo sapiens
aaatgcagagtgaagcagagacaggaaatcggggctctcagtaatgagttccagccactccagaagggggaagccagacaaggaattttcttcaggactgtttccctctggcaggctccgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagggtctacagtggctaccggggcctcagcccccttgatgcccctgaactggatgggctggaccagatggcaccttcggaaggtaccgtgacgcagatagggctcctctcccaagacattcaccgccttacgacaatgctgagccaggaccagctgctgaatgactctcgcctgcctgcccccaactctgatgactggagatgactttcttcgtggctgagagcgtagggaggcatgtgtgggggccccggagcctttgcttctgtggggagcgggcacacagccccctctgcaagcccagtccgggctggcagggtgtctcagacaggctgctgacaggcatgaagcagagctgtgggacaggtgtccaggggtggccccagggtccatgtgtgtcttcaaccatgctgcgctcttcaccgcaggcttcataccttttgtacttttatacgtggactgcagaccactttgtggg

SEQ ID NO: 6568 - DNA, 2314 bp, Homo sapiens
ccaccaaggcatctaactgctgacatgggtgcccagcatggatggggacattgatgtttacaagcatttctcgtggctgaagaggtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccaggtgggacagattagctgatgcccttgtcacctgccctctgtgcaccctgagagctcacagtaacactgtgtgtgtcaccatataa

SEQ ID NO: 6569 - DNA, 704 bp, Homo sapiens
aggtcgccctgccccctacccaccatgccagatccagcatcgttgtgggcaaacaattatctggatgatctttatggggcttaagcttgggtgggagcagatggggcatgagctggggatttggggatggggggaatccacacccccacgtcctggacgtttaaaaggccctctctggcactgggccggggcagaggccagcagaaaagtgactggagtccagggacatgatggatcaggaggagaagacggaggaaggctcaggcccctgtgccgaggcgggctccccagaccaggagggcttcttcaatctgctgagccacgtgcagggcgaccggatggagggacagcgctgttcactgcaagccgggccgggccagaccaccaagagccagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctgggaccctcagtccccaacccctgctcacccctcaggacccgaccgctctcggcttccgtcggaacagcagcccccagcccccgacacaagccccctgagggcctgaggcatcctgggtctcactcggcccccaaaaactgataaaagaataaaacacttaaatg

SEQ ID NO: 6570 - DNA, 1424 bp, Homo sapiens
ggccggaggcggcgagctgagcggctctgacaggacgggtcgcagggggtcgcctggccggagctgggctccgagaatcccgggtgccagcaccagagcagcggctctccgcactaactctcctctcctggtcagctgtaacccctgccgcagagcccggcaactttcagctgtcgcccgcggagccccgagggccactcgcctcacctgtgcgtgcagcgcctcgcgcgccctgtccggctgcggagatgagcgagcttaataccaaaacatccccagcaaccaaccaggcagctggccaagaggaaaaaggaaaagctggcaatgtcaagaaggcggaggaggaggaggagattgacattgatctgacagcaccagaaacagagaaggctgcccttgctattcagggcaagttccggcgatttcagaaaaggaaaaaggatcccagctcctgaatggccaggcttgcccttcaccttcaccttcatgctggtcccttctctccccttctccacacccatgtatctttatcccttgtccctctagcctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggttctttgatcagtagctatgcctgccctgtagggctaaacaagaggcttcgaggctgagagatctccccaaagaacaatgtgggaaggaggggaaggctttcagagtagggtgcctgagggtgggacatatgcactgttctgctagttacggcattcacactttaggtaacattttttttccccttcagatccttctgcaccaactccaacttcccctcccaggatctaagccacagtggggactggagcctcgttttccccctaggcagacctaaatcaagcagcttaccacaatagtgcatgctgagtagattagttccaaggaagggagactggaatgctggtgtcaaggaaaagcctccctcatcatctagtctaagaccataacgggcagaagcataagaggttccagggccataggagaatgagaagtagggcacatatagggaggaaagaaaagtgaagaagggggaaatctctgaatttttttactgctgggaaaagtgtactacatgaaggatgcttggggctttgctaacctgctcaccgctaaccctccaagtctaaccatccccagaggccacacaaaccaagtgactcctgtagttcccatttgccccactatggagtcagggcaaaagtggaatagccactccatgtgattttagcatgtttaatcattttaacaataaaccaccccacaaatggggtcatttaacctcta

SEQ ID NO: 6571 - DNA, 1559 bp, Homo sapiens
atgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactgcagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaagtatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcaatagaggttgctgctaaaaccttgcctttttataaggactacttcaatgttccttatcctctacctaaaattgatctcattgctattgcagactttgcagctggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttg

SEQ ID NO: 6572 - DNA, 1424 bp, Homo sapiens
ctttccctagtactctgcaaacaggtaataactctttccaatactttgtattttgtttagtatgccactttttggaagtggtcactgtcaatatcttgttatggtttgatggccttggagatttaaaaccgagtaaaagtgtacgggaaccttaaagatagattttgttggagagctgaatgacaaaatgaaaggtttctatagaagtaagtatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcaatagaggttgctgctaaaaccttgcctttttataaggactacttcaatgttccttatcctctacctaaaattgatctcattgctattgcagactttgcagctggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcag

SEQ ID NO: 6573 - DNA, 729 bp, Homo sapiens
ctagttaaaactgcaaagttgggcacctcctggaactacctctttgacttccaccctcacagggtcctggtcgtgggagccttcgccaacttctgcacagagcccacgggctgctcctgcctcttccccaaactcccgccacacctgctcatgctgccttgttggttccatctcctcttcttccaggactacatcatgtcaggtgcttctgccctccccccaggtttggtctcctttgtcaaggccccgctgcctcagtggtggccaggtggctgtcctggcgtgggagggcccctgcaggcgctggaggcaaaacccggacaactgagcttgccgattcggaatcagaagagattggttaagtcagctctggaactcggggagaatgagctcttccagcagttcccgaacccgcagagctcgtgggtgcagaggacgcaggaggctctgcgtccgctgctaagcgtggccctgcagctgttcctgggccgccggggcctcccgctgcccttccgcgcgcccatccgcaccgtagtggggtcggcgattcccgtgcagcagagccccccgcccagtccggcccaggtggacacgctgcaagcgcgctacgtggggcgactcacgcagctcttcgaggagcaccaggcgcgctatggtgtccccgccgacagacacctggtcctcacggaggcgcgccccaccgcctggcctcgcctgtccgctgggtga

SEQ ID NO: 6574 - DNA, 1602 bp, Homo sapiens
ctcttttggcaacatggcgggcggagaagctggggtgactctggggcagccgcacctttcgcgtcaggatctcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttatcgatcttgtgggagcagtatgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaatcaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccggttaaataatacattcggatggagctggaagttgcaatttctctttaacaaccaaggggtttattttcaaagcgatattggggaattgatttcacagtttgttaccttagtaggtaacggtaaggttattctctctttttttttttggttatgaaaactta

SEQ ID NO: 6575 - DNA, 860 bp, Homo sapiens
cgtgagggtactctgccggttttgctgcggaagtcacctcgtggcgtaggggagaggtaacaccgagaagaggcagcggcggtggcgccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaacaacaggaacaaagaaaaagtcttaggaaaagaagttttattattgatgcaagccctaaacactttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagtt

SEQ ID NO: 6576 - DNA, 864 bp, Homo sapiens
cgtgagggtactctgccggttttgctgcggaagtcacctcgtggcgtaggggagaggtaacaccgagaagaggcagcggcggtggcgccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagtt

SEQ ID NO: 6577 - DNA, 1532 bp, Homo sapiens
tttccttctcagtcacaggaccggatggcaagtggccgcagccagtcggtgagaccgactgagctctggggcttcagttcttgacgctacctacatggctacatctccagccaaggatgagagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggtaataatctctgctctgtggttggatgttgtcacatactggtctttttgttttacattttctgcagcatgagtgattatgaacttggcctgtttggaggtaaatgttgcctggtaaacttgtttcttcacttggtttagtccacctatcatctccagttatgtgtagggaacaaaaatagcaaaatacgaagcccagttataagaaacttaattatttctctgtgtaacaagaactgaagttttaagaaagtttgaggccaatatgatgtaattagtatttgatttaccttgctttttgtacctttgaaaataacctaatagtatgaaaacaatatgtatgctaattttgcttaaaagattatacactgaaatttagagaggatataatgttatctgtagtgtagaaagagttaaataagactgatttttagaatttgttttatcccttccactcttagcttgacaattaggattaagaatatgatatgtcaaatttcatgactgaaatctgaaatgccttaatagttgccctcagtgtttcatccttatactaacatttacattgatatatatgacttatatgtgacactgaaacttggaatttttattcttaatccattttctgttaccctggaagacaaaaaaaaaagtatggtaatatataaagtaattgtaattccttgaaaataagacagatatcttcaaaattgatagccccaattatatgtgtaaaatatagcttgaggttaaaattatttaaaaagttttaaatgaaaatctttatgaaaatgtcagttatattatagttgtttcttacacatacacattcaataacaatatttatttattcttttttctagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtact

SEQ ID NO: 6578 - DNA, 832 bp, Homo sapiens
tcacctcgtggcgtaggggagaggtaacaccgagaagaggcagcggcggtggcgccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagtta

SEQ ID NO: 6579 - DNA, 2016 bp, Homo sapiens
gtagctgcagctgcgcattgcacccccagctacgcagtctcctttccttctcagtcacaggaccggatggcaagtggccgcagccagtcggtgagaccgactgagctctggggcttcagttcttgacgctacctacatggctacatctccagccaaggatgagaggatgcagaaataatatttgtgttgttttaaaaatcttagatcaattaaaaagaaaaatgactctgtcattctttgtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaattttatgtgcatacagaagcattatttgaagtcagcctgttttccctcaacctctagtactctgtaaagtataccaaaagtcaaggttttaaagaactgtgttacatattagagagaacaaatcaaaagttacctatctccatcgttaccagtagaacattagtatgtattttgaagcaccatttgactctttctatttcagctacttgcttgtcccttgcaaagttattatagtactcttttaaaacttttcttcaagggaagagctattttgacttccttttctttgatctaaacctaacacccagaatatgcttagcagatcatcccaaaacaatcataacttgtttaaattgttcatagcaaaagttacatattataaagagttatgagtgtcttaggcagtgaatagtaactgaatatccttttatagttgtccttcactagcaggaagccttattccctgcccttttacatatcttaacttagaatgttactgtctaaatagtggttaggcaagagtagttcttaaacgtgcagtaattatcttgcactacatttaagggctaaatagctagtagtggtgcttgataattgaagaaatttgtacagctggaggaagtacctgctaaattttcaaaagttacctgaatttaataggtaaatctgtttttaattagagctatatcattttactctgaatgtcttaacatagaagtttacataaaatttacagattggattgatttcagccttcttctggtactttttaaaatcttattaatcattaggaaaagaagttttattattgatgcaagccctaaacactctttcgactccagaggagaagctggcagctctctgtaagaaatatgctgatcttgtgagtatttatttaatggagcaaggaacacagaaaataaaatctatgtgtgcttgataagatttttaaatattattttgatgtaactttaaatgtaaaatgatattttatctcaaaattgaaaacaatctcctttctttagtacttatgattggtgtgtgtgacttcatcttatgaaatgatgtatagaacataataatacttttttaaatgtgaaataaatttcctaaaactt

SEQ ID NO: 6580 - DNA, 7299 bp, Homo sapiens
atagtcagtgtgagtttgagaaagaaaaacacactgtagagctctactataaaagttaataggatagattgttaaactacattctgccatctttggctatttggttgctaaatactttagaatattacttacagctaggctgattataacagaagaaggattaagtatgacagcttgtctcaataatggaagtaaaaagcagagatcctggaaagaatctgccatccatcagaggaatttgtctgactttgtggtattgctagggggtgtatggttggagtattattttgatggtgctggatcaccctcatcacagtaaactcaagaacataggacagcttgtgaaataggttcttacttgtaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaattacatgtttattaggaaaagagtagaaacctgtaaacagaatgactaaattggagcatcacttggcccaagtgtcagtggagtaggataagtaaagggatttctaggagatgtgtaccacttgtctcccatatgatgctacaagattgtcaatatagcatacagatatttttctcttatgcagtctaataatacagatttgttccctaaatactctgtatctcagatttctgtgacaatctgaacaatataaataggagaattgtgctatttgtgagaataaggaacctactaattacccatcaccaagtcacattgtttgtgtaatcaatgaagtaaaaagtttgtggaggactcaatagttgtcgaacctagtcattggagttattttataaattgatgtggaagttgtatgatggctaaataaaaaacaaataggtgataacctgcttatttgtttttattttttctttacttttagaggtctatacatagggtaagatttcaattttcaaaggatgcatccccttcctttattatgctttaagctagtaaaatatatatttaaatccttacttagtagattaaaattggaaatagaaagtgacaatttaaaaattaataaaacagtaaatattactttatgcatatcaaaatgttattttgagttacaccttttcatgctacttttgaaaacatttttctttaagattttgagtatcttttaaaccattttcctctatgtttcaagaacatttcaaacttattatggaagctgcaaacttatagtagaatatatcacttggctttagcaattatttacttttgtttctagcaactcttgtttccatctatttttaagcaaatccaagatattatatcattttatttattactattcaaatatgcatcatgaaataagattctttttaagccataatcactgtactatttttactccaaaaggttaaacaattgctatgtaatcacataccttctcactgtactatttaaatatctgttacttcccttttccttcaggttgtttacatcaacatcaaaataaggtttatacattttattgttttaatatgtctcaagtctttttagtatataagcttcccccccctcttttttttccttggaatgtatttattaaagaaattttttaggcctatatagtgaacttttaaaattaaatttgttttatattataaagcatattatgaatatcatcagtttttttaaaagaatcctttaaattccattgttttaaataatggtattaaaaatgattaattttattttattttttattattttactctttaggatttatattattttaactgtattaaactctccaaatttgctatagaagtagcagattgggagaggacatgtgttcaagttgtactacttgtatgtcttgtttagatattacagtctttttcttttatcagaaaataattgaataatgataaaatcagttgcagattaagacagattatctgttgcagtcttctcaaaacttaatttaagtacattattttcagctagcatttcttccttcacatagaacctccatgtgtggagggatttcctaatgagtctattgtatgtacaatagcacttaatgacatagcttttaaataataacaggattttaccaaatgtttaatatgtgccaggcatcaagcaccttacacagtttaattattgcatagatttggacagcaactctgcaagttaggtatggtcatgaacctttgcagataaggaaactgtgtttcacaaggagaagaaattgtcctggatcatacaataagctaggatttgctccagaccatttttttcattttatcaggctacctacaattaaggaatttcagaagattttgtgaacaaaaaatgtccaggaattatgtgtgtaataaatgaatttgatattttgatctccttatccatctttttcttgataaaatatcagcttttttttttccaatgtagggcagaagcaagaagtacagatattttgatggggacagcccacgtctgatagggtgggacatggggcagcagttagagggttgtgctctttctagtgtgggatagtttgcaagatgatatgttgtagccacttctgcagtgacggggacagaaggagtcagtgttcttaactacagtggtagcagcagaaaagaagggtaagcagggttctagaaatttgtgttatgttttctccccactgtatttatttctttggttagtggtgcaagaaattctgttttcctgtagcaaattaataaagcgttcaaacataaggaattacgacaacagcttgtagatgccagacttcaacaaacagcacagctgataaaagaagctgatgaaagacatcagagagagagagagtttgtaagttctacttcttggaaaaaaaaaaaagatcgccaaaattgtaaccaaagccatttaaaacaaactcctcacttaacatagtgccagggcatgcaattttgtttcttactctctggatgtgggatatgcgagtgtgtgtgtgtgtgtgtgtgtgtgtgtattaagctttctgtttctgatgaaattttcatatgaaatttactggagataagattaaattagtggaaaaacaagataattttgctttctatgtagtggtcaccaagttaaagaattgtgccagttattaggcaagataggctttgagatttagggacagttaaattttacaccaacttagtgaacatgagacttctacctagtgttacatttcatttttaaataagcaatttaaaaattggtaaatgatttgtttactttgattatattctggtataattttctgacaaaattatctgtgtcttggtcagcattgttgctagaatatgtattcagattttgtctgtccataattgagaacacagaaaaaatctaatttgactatacccatttacccccatggaaatgaaactatattctatgaatgaaaaatgattttaataatgtggtgtattacattttcttcattcaagtaatgtaggccctgagtagagcatgttatgaatatttagttccttagtgttttctcattcaagcctctcatattgaatgagtctagggtttggagagatgtttcacacagcatgtctcttcagtgcaagctgacagatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttctaaataacctagacaatgtcaagattcttagctgcgttttctgtctaaaagtgtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaagattaagtgtgatcattgtactgatggatatattttgtgtacatgtttctcttttagttgtaactattgattttgtaatgaaaatttcctctcctttttctaccatatctctgtttttttagaactactcaactgtgtggtaacagaaagcttcttaccaatttccccaactatgttgcacatcagcctcattttccccctttattggaatgcatgttttcattgccttctcctttcaaagtgtacgtttgtgtgttcatcaccttaaattatcttaatttgagacttttttataatggtttcgtaatgtgaaatcaaatactaatttaaactctggagcccataatatctacataaaagaaaatataaactgactaatattgtcaagtcatttaaatgataagtaaaacttcaatggattaagaaacaagcatggcatatttgattcagatcagttttttgacaatatttgtatgactttccaaattgatgtgactgtaaactttgaattcctcaaaattgacagaatatatatatatatatatatatatatatatatatatatgtatgtacacacacacagagagatcatttaaatgtaaatgatgttaagaaaaaccaaaacagtagcatatgcaggcaagtcattggaccaataggcttaatatttatgaaactgacaattgttctgctttagtttcaggttacaattatgtttaaagaaaaaaaaatcagtatctagatctctgcacttggcatggaaaattttgaactatttattccttaattttcttttatttcagtttctcatagagctaaatggttttacatatattctcttgtcagatttgtggtctaatagaggtagaaaatggaaattttcccagtacttagaaatatggtacttaggaagaagtctaggatgtgaattacatatacacttcccctagtgactatgataatcaagggggcagatagcagaggaaaataagttaacatgaaatttgacaaattttattactttgccaaaattagcaaaacaaaaatactcaccttcccctgctcaccccccaactttttataaatattcaattcagctacaaaacaaaatactggacccacttctttcagaagagatgaagataccttatatgccctaaagttaataccagcagtcatattttatcagatgtaaatctggatgtaagctcttaatgttatactaaggcagtttcttaggctgtgacacttctttgtggtacttgttttgtgtgaaaggtaaattttggggagaaaacaatgtgaaaaacagaacttgttctgttgtttttggcatactgtttatgttagatacactgtgttacaatacaatattacgaagatctgcattgtattttggaatttggtttcctttcagaattattgctctggctagcattggaaacaacaacaacaacaaaacccaaaggaaccctttgcagaagattcccttgtaaatggccctgtggcatgcccagtatctgcaatgttctagaatagaagttggcaaacctctctgtttgccaagcctgcagagttgaacatgtccataaatgtatacaatctgaccctgttttttggccctgtttctggacactgtagctgaccaagaaaatgtttaaatgttgcgatcaattaaatttttttgttgtatcattctggagttgtaatatgtatagtggcaggggattccaagctatagaaaaaacatgagtctagaatgacagagtgtgtcatcttcaaatgtgtattaatatatttcttgatgatgagaccaatatttctaagttaatggaactattttattacacctgataatcacagttcaattcttgtctgttgcagaattatctacctctttcaaactgtaaatgaaaataactgtgaaaaaaaggatgcagtactgataaaaacactgctttgtttttatctcacctcttttttaaggatatgattttataagaggcagttctcttttgcttttcaagacttctgtagagtttgtgttttttgtttttgtttttgtttttgtttttgtttttttacctaatgtgaatcttattttatctactcaacttcgttcaggttaactaaagatatagatataatggttaa

SEQ ID NO: 6581 - DNA, 3315 bp, Homo sapiens
ttgattatattctggtataattttctgacaaaattatctgtgtcttggtcagcattgttgctagaatatgtattcagattttgtctgtccataattgagaacacagaaaaaatctaatttgactatacccatttacccccatggaaatgaaactatattctatgaatgaaaaatgattttaataatgtggtgtattacattttcttcattcaagtaatgtaggccctgagtagagcatgttatgaatatttagttccttagtgttttctcattcaagcctctcatattgaatgagtctagggtttggagagatgtttcacacagcatgtctcttcagtgcaagctgacagatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttctaaataacctagacaatgtcaagattcttagctgcgttttctgtctaaaagtgtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaagattaagtgtgatcattgtactgatggatatattttgtgtacatgtttctcttttagttgtaactattgattttgtaatgaaaatttcctctcctttttctaccatatctctgtttttttagaactactcaactgtgtggtaacagaaagcttcttaccaatttccccaactatgttgcacatcagcctcattttccccctttattggaatgcatgttttcattgccttctcctttcaaagtgtacgtttgtgtgttcatcaccttaaattatcttaatttgagacttttttataatggtttcgtaatgtgaaatcaaatactaatttaaactctggagcccataatatctacataaaagaaaatataaactgactaatattgtcaagtcatttaaatgataagtaaaacttcaatggattaagaaacaagcatggcatatttgattcagatcagttttttgacaatatttgtatgactttccaaattgatgtgactgtaaactttgaattcctcaaaattgacagaatatatatatatatatatatatatatatatatatatatgtatgtacacacacacagagagatcatttaaatgtaaatgatgttaagaaaaaccaaaacagtagcatatgcaggcaagtcattggaccaataggcttaatatttatgaaactgacaattgttctgctttagtttcaggttacaattatgtttaaagaaaaaaaaatcagtatctagatctctgcacttggcatggaaaattttgaactatttattccttaattttcttttatttcagtttctcatagagctaaatggttttacatatattctcttgtcagatttgtggtctaatagaggtagaaaatggaaattttcccagtacttagaaatatggtacttaggaagaagtctaggatgtgaattacatatacacttcccctagtgactatgataatcaagggggcagatagcagaggaaaataagttaacatgaaatttgacaaattttattactttgccaaaattagcaaaacaaaaatactcaccttcccctgctcaccccccaactttttataaatattcaattcagctacaaaacaaaatactggacccacttctttcagaagagatgaagataccttatatgccctaaagttaataccagcagtcatattttatcagatgtaaatctggatgtaagctcttaatgttatactaaggcagtttcttaggctgtgacacttctttgtggtacttgttttgtgtgaaaggtaaattttggggagaaaacaatgtgaaaaacagaacttgttctgttgtttttggcatactgtttatgttagatacactgtgttacaatacaatattacgaagatctgcattgtattttggaatttggtttcctttcagaattattgctctggctagcattggaaacaacaacaacaacaaaacccaaaggaaccctttgcagaagattcccttgtaaatggccctgtggcatgcccagtatctgcaatgttctagaatagaagttggcaaacctctctgtttgccaagcctgcagagttgaacatgtccataaatgtatacaatctgaccctgttttttggccctgtttctggacactgtagctgaccaagaaaatgtttaaatgttgcgatcaattaaatttttttgttgta

SEQ ID NO: 6582 - DNA, 789 bp, Homo sapiens
atggacagggccaagcagcagcaggcgctgctcctcctccctgtctgcctcgccctcaccttctccctcaccgccgtggtcagcagccactggtgtgaggggacccgacgggtggtgaagccactgtgccaggaccagccgggagggcagcactgcattcacttcaaacgggacaacagcagcaatggcaggatggacaacaatagccaggctgtcctgtacatttgggagctgggtgatgacaagttcattcagcgggggttccatgtggggctctggcagtcctgcgaggagagcctcaacggtgaagatgaaaagtgtaggagtttccggagtgtagtgccagctgaagaacaaggtgttttgtggctgtccatcgggggcgaggtcctggatatcgttctgatactgacaagcgccatcctcctgggctccagagtgagttgtcgcagccctgggttccactggctcagggtggatgccttggtagccatcttcatggtgctggcagggcttctaggcatggtggcccacatgatgtacacaaccatttttcaaatcactgtgaaccttggaccagaagattggaagcctcagacctgggactatggctggtcatattgccttgcctggggttctttcgccctctgcctggctgtgtcggtctcggccatgagcaggttcacggcagcccgcctggaattcaccgagaagcagcaggcacagaacggcagtcggcactctcaacacagcttcctggaacccgaggcttcggagagcatttggaaa

SEQ ID NO: 6583 - DNA, 986 bp, Homo sapiens
agtcacacagctgcctggtaggtgactggaggccttgatcggttcttattgggattttgctgctgtggccccaacccttcctccctccccaccctgcaatggcagaagaaactcaacacaacaaattggctgcagccaagaaaaagttaaaagaatattggcagaaaaacagacctagagttccagcaggagtgaacagaaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggtgaaggagacggaaacctccaccccatccaagaagggctgggaggcgggcagcagcctcttgggaggggaggtgccaggtcagaggcagcttccagcctgggggctggtgaccacagcaccccgcagggcagtcctgcgactgtttctcgcttcctgcctctga

SEQ ID NO: 6584 - DNA, 986 bp, Homo sapiens
agtcacacagctgcctggtaggtgactggaggccttgatcggttcttattgggattttgctgctgtggccccaacccttcctccctccccaccctgcaatggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggtgaaggagacggaaacctccaccccatccaagaagggctgggaggcgggcagcagcctcttgggaggggaggtgccaggtcagaggcagcttccagcctgggggctggtgaccacagcaccccgcagggcagtcctgcgactgtttctcgcttcctgcctctga

SEQ ID NO: 6585 - DNA, 750 bp, Homo sapiens
catctccatgtgcactctcatctcttgtagtcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggtgaaggagacggaaacctccaccccatccaagaagggctgggaggcgggcagcagcctcttgggaggggaggtgccaggtcagaggcagcttccagcctgggggctggtgaccacagcaccccgcagggcagtcctgcgactgtttctcgcttcctgcctctga

SEQ ID NO: 6586 - DNA, 1997 bp, Homo sapiens
agtcacacagctgcctggtaggtgactggaggccttgatcggttcttattgggattttgctgctgtggccccaacccttcctccctccccaccctgcgatggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgtctgcaacattcattgcagtgtaaaggagagttagagagcgctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgagcctcatggctctccctggggaaggacacggaggagaacatctggacagtgagggggaggaggcacctcagcccatgccgagtgtcccagaggacctggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 6587 - DNA, 2318 bp, Homo sapiens
atggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagcgctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgct

SEQ ID NO: 6588 - DNA, 2010 bp, Homo sapiens
acttccgctcgagcgcgcctcgcgcggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggtgggagcacagcatggccgtgggaacgagtgctctcagcaaggagccgtggtggaccctgcccgaaaactttcattctccaatggtgttccacatggaagaggaccaggaggagctcatcttcggacttgatgacacgtaccttcgctgcattgagctgcacagccacacccttattcagctggtgtttcacagctacaggccagacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttgatggagtcttactctgtcgcccaggctggagtacaatggtgcgaactcagccacctgctacctctgccttctgggttcaagcaattctctgcctcagcctcctgagtaactggaattgcaggtcagagcagagcatggccatgggaacaagtgccctcagcaagaagccgtggtagaccctgcctgaaaactttcatgatccaatggtgtttcacatggaagaggaccaggaggagctcatctttggtgagtggcctttgcccacatcccctccttcatccttgtcttctccattttcaatttttcccttctttcctaccttcatcagtcacacatcggttcccccaaggctacctccccactccccaagggctggtgcttgatagaccctcctctcgcctcttatgctcacagggcatggtgacacataccttcactgcattgaggtgcacagcccctgaccaaccatgatctggtcgcctccattagtgtgccaccgtacaccagagacctgtctttggcctccaggataagtggaaccgtctgtcttagcgtacctcagcctttcccttaccaagtgattggtcgttaggtattctatttgagttcactctattcgtaattaaggacagatctcccctgggaagtggggatgagaggagaagtcttggcttcacttttggtgagaaagacatgaaagacactgaagaaagtttgaacttgtggcggggacctgtccctctcaggccttctaggcacgtgcctgagggaagtctcctgagtgtaagaagtgttattggcaaagcaatccaataaaataagctacctgtgatgc

SEQ ID NO: 6589 - DNA, 1372 bp, Homo sapiens
ggccgtggctggcgggtttctatggtgatgcagcccaagtcccagagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgtgggatcctgagcgcctggagcctgtggaaacgggctccagaggcgccctacgcctccggggaggagcccctggctctgcggcaggttttcgggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctgccctgcacaggatcgagaaggaaggagctcctccccagtgccccctcctaggctcaaggccatgacctcacaggcgaggaagcaaaatggaggggccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctc

SEQ ID NO: 6590 - DNA, 983 bp, Homo sapiens
agtatttgagggaacatccgggctctggactagactttcaggatctaaggctgaatcctacacagtcctccctctgggaaagtgatgaaacctgtgagctctcctagcaactctgcagtcttccttcaagggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtgggactggaaaatatcttaaagtgaacagccaggtacataccgtgggctgtgactactgtgggccactggtagagattgcccggaatagaggatgtgaagccatgggacttgagcatccatggatttggtatccgagggcgtcctggaaccaaccccccacggatattgagggaccacagtatttttatcctccatgtcaccccatccctgacctccagaaacaaacaatcatttgccattttaaaggacctacactaaatgagcaacagaagagctctcccacccaccaccgactccatgcctgttttcagcattgtagggaggaagagtcccggccctggctgatggctctcagctcctgggatcaggtggcaatggagggtcatgtctcggcttcattgacttcttgcatcgtaaggctcctcttatgagacaacctttcctctcaggcccttaggtccaagtcccctctctcagctttctctgagacctca

SEQ ID NO: 6591 - DNA, 2188 bp, Homo sapiens
gatgcatatgttccttcaacttattcagtacttccatgtgcagggctctggactagactttcaggatctaaggctgaatcctacacagtcctccctctgggaaagtgatgaaacctgtgagctctcctagcaactctgcagtcttccttcaagggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcactttgagaagcaagacgtgcttgttccatggaacagggctctgtgttcccagctcttctcagagtccagccagtctgggaggaagaggcagtgtggatacccagaaagaggccatccctaccatcctccttgctctgagtgtagctgttctgtttgttttaaagagcagtgtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtttagactttgatcaccaagagccattttcaacaaaagggcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagttgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagagaggttgtgattgattggatccttttagacaactcctccaaaagatgaaccacattctttcctcttggtttgatatggttacctgaatttgcattcagtgttatttgttaatccatttacgctttggtctgcagagactattaattatttggttgttttgttttcatttttgaataagcacagattctggcattgaaagcacttgacaaagggtatttgtgcttaaatgttaatatacaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttg

SEQ ID NO: 6592 - DNA, 6003 bp, Homo sapiens
atgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccgtctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgaggatagcatgtaacgcaggtttttctcttataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcactttgagaagcaagacgtgcttgttccatggaacagggctctgtgttcccagctcttctcagagtccagccagtctgggaggaagaggcagtgtggatacccagaaagaggccatccctaccatcctccttgctctgagtgtagctgttctgtttgttttaaagagcagtgtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtttagactttgatcaccaagagccattttcaacaaaagggcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagttgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagagaggttgtgattgattggatccttttagacaactcctccaaaagatgaaccacattctttcctcttggtttgatatggttacctgaatttgcattcagtgttatttgttaatccatttacgctttggtctgcagagactattaattatttggttgttttgttttcatttttgaataagcacagattctggcattgaaagcacttgacaaagggtatttgtgcttaaatgttaatatacaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaacaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaaggatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcgttgttagcttgtaaggagtggagtatgtaggtagtaggagttatatgcaagtacccaagtggtattcttccaatcttattagaagcatgaatattcaagattgatattactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctctttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcaccgtgttagccaggatggtctcgatctcctgacgtcgtgatccacccgcctcggccccccacagtgctgggattacaggcgtgagccaccgcgcccggcctgttccttttatttcttaattcaggacactaaaccatgactgcaagggatttccttggtaaaaagaaaagattctcagagtcaaaatggtcttacaactcgggcttgacggcctttgaattatgaatggattgttcctctctctgaagcctattgtcacatgggtttttaatcctggccttgctgctagaaatctgtgcttgaagtcctctctttctgctgctagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactatctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtct

SEQ ID NO: 6593 - DNA, 2826 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 6594 - DNA, 3606 bp, Homo sapiens
aggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaatactgcagtcctt

SEQ ID NO: 6595 - DNA, 3807 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 6596 - DNA, 1342 bp, Homo sapiens
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 6597 - DNA, 2174 bp, Homo sapiens
attggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcctgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccaaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcatcacccgaacccaagaggcggaggttgagctgagaagaggccagtgcactcaagcctgagcaataagaataaaaccgagt

SEQ ID NO: 6598 - DNA, 1342 bp, Homo sapiens
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcctgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccaaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcatcacccgaacccaagaggcggaggttgagctgagaagaggccagtgcactcaagcctgagcaataagaataaaaccgagt

SEQ ID NO: 6599 - DNA, 4270 bp, Homo sapiens
attcaatagatgcgcccagcattcagattgccttttctctcaaccaggatctttaaagtcgatgacaagagttccagtcctgaatcatggcaaagtgcagtagtgaactgcggggttattctggaaggatctctctatggctgatggtctcagttccggcatcagcctctgactgagaataaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacacacatagtgcacctcatagaagcttttaatagtctttatatttactaaagaataggactaactatggaactatgaagatgagctggaaatgacaggtgacttgccagcaggccagagtgtgacttttttttgtccctcaatgggaggtgtcaattctcccttcggttgtgagaatcagttggttcatttgtgggaaggttgcaggggggatctttgaatcacagccttcagatgccagaagggcagagggaatcccacacgggctggtggatcatgtgtgtgcatttctctcccttctaatctgaggaaactaagcgtgaaagaatgtgagcatgcagaaaaggagaggcaggtatcagaggcagaggaaaatgggaaattggatatgaaagaaatacacacctacaagtgagttcagaaactgaaccccaccctcctgggaaacgcccattggagtgttgtttttaacctttgtacagtatttagacccagtaaatgcagaaatagaaacaaacggtcagaagacatatcgtgagagagagcgagagagagttcacaaaacagaaaacaaagtaccttaatatttaccagtgaccaaaagatgtgaagtagcaaaacgtctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaggatattaatacaaagagaatacagctttatgataaaagatgctcaatgaaggatgaattagggatgtactgagaatggggaaggaaactatcatctcagaagtcagcaggcagtaagcaagaggaggaatcaatacagcaacagtttggatcagactgtacagtttttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacgcctggctaattttttgtatttttagtagagaaggggtttcaccatattagccacaatggtctcaatctcctgacctcgtgatccatctgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcctgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggaggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccaaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcatcacccgaacccaagaggcggaggttgagctgagaagaggccagtgcactcaagcctgagcaataagaataaaaccgagt

SEQ ID NO: 6600 - DNA, 2576 bp, Homo sapiens
atacgagaattagcgactcccagccgccgcccgggcccgcgcgctcctccgccgcgctccgctcggctcctctcgaccccacaccgccggtcgacatgatccgctgcggcctggcctgcgagcgctgccgctggatcctgaccctgctcctactcagcgccatcgccttcgacatcatcgcgctggccggccgcggctggctgcagtcgagcgaccgcgtccagacgtcctcgctgtggtggagatgtttccttccacaggggcggcggcggcggcagcgggtcctaagaggacggctgccacagcctcatggagtacgcgtggggtcgagcagcgctgccatgcttttctggggcgtcagcatcctggtgatctgtttcatcctctccttcttcgtcctgtgtgtaccccagatacttgtcttcctaagagtgattggaggtctccttgccttggctgctgtgttccagatcatctccctggtaatttaccccgtgaagtacactcaaccttcaaccttcatgccaagccccgctgtcacttccatctataactgggcctgcggctttgggtgggcagccatgattatcctcattggctgtgctttcttctgctgctgcctccccagctgcgaagatgacctcctgggcaataccaagcccaggtacttctacacatccgcctaacttgggaatgagtgtgggagaaaatcgccactgccaagatggactccagaagaagaaactgtttctctaggctacttcgaacttattttttggcagtgttcatattctcaaactagtcaaaaatgctaaaataatttgggagaaaatatttttaaagtagtgttatagtttcatgttcatcttttattatgttttgtgaagttgtgtcttttcactaattacctatactatgccaatatttccttatatctacccataacatttatgctatgtttgtaagagaatatgaacatgaaacttaacactttataaggtaaaaatgagatggtttccaagatttaataattggatcaagttcttgttatttccaaatagaatggacttggtctgttaagggctaaggagaagaggaaggtaatggtaaaaattgtcaatgactggccgggtgtggtggctcacgcttgtaatctcagcactttgggaggccgaggcaggccaatcacctgaggtcacaagttcaagaccagcctggcaaacatggtgaaacgccgtctctactgaaaatacaaaaattagccaggcttggtggcacatgcctgtagtcccagctactggggaggctgaggcaggagaatcgcttgaaccagagaggtggaggttgcagtgaaccgagattgtgccattgcactacagcctggtcaacagagcaagactctgtctcaaaacaaacaaaaattgtcaatgaccaaacattctaaaagaaatgccaaaaaaaaagctttttttttcaagccttcaaactatttaaggaagcaaaatagtttcctaaatgcatattgtttgtgagaatttctcattaatatcctgaataattctttttttttttttgagacggagtctcactctgtctcccaggctggagtgtgatggcgtgatctcggctcactgcaagctctgcctctcgggttcacgctatcctcccgcctcagcctcccgagtagctgggactacaggcgtccaccaccacgcccggctaattttttgtatttttagtagagacagggttttaccgtgttagccatgatggtctcgatctcctgacctcgtgatctgcccacctcagcctcccaaagtgccgggattacaggcgtgagccaccgcgcccagccctgaataattcattcttgctaagcttcatgttgactctatatatcatctaagaaagtattgttttgtggtccaaacctgttgccgtggttagtaaggctttcttaggtgtgaaatatttagatgaaattttctcttttaaagttctgtatagggttagggtgttggaaaatgctatattaataaatctgtagtgttttgtgtttataggttcagaaccagagtaactggattgaaagatggactgatagattagatatatcagtctaatttatcatgactgatagatctggttaagttgtgtactaaaggattaggagagcccttcctgtcacaaaagtgccactaaaacagcctaaggagaaaaatggcttgcttttctaaacttcagatgtatctgggctctaatcatatagacaggcttctgatagattgcaactgtaagtagaaacctacatatagttaaaatcctggtctttcttggtaaacagatttaaaatgtctgatgtaaaacatgccacaggagaattcagggatttgagtttccctgaatagcatatatatgatgcatcaaatgggttattactattttttaccatttccacttacataatgaaaaacaattcattttaaatatcacattattattttgtaagtcatggaaaagggcaattgaagttttcattatgaagttttcccaataaaccaggaattctaaacttg

SEQ ID NO: 6601 - DNA, 1882 bp, Homo sapiens
aagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatagaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggcattccagcgcatcaacagtgcactgcaggttgaggacaaggccatctcggactgcagaccctcacgaccttcccacactttgtcctcacttgcaacagggacttctggtctgcctgccatttctaaagcacccagtatggatgtacagcaggagacacacaagtcccaagactgcctgggcctactggcccccttagcatctgctgcaggtgtcccctctacagctcccatgtctgggaagaagcacaaaccaccaggccccctgttctcctcctcagatccccttcctgccacctcttcccattcccaggactcagcccaggtcacctcgctgattcctgcccccttcccagctgcaagcatggatgtgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaacctcagttcctgaaacacagtgagtgaggacggacctcaggctgtctcttcgggtcacacccagtgtgaaaagatggcagatacagcaccagggcagacactcgcccccaggggtggctccc

SEQ ID NO: 6602 - DNA, 1341 bp, Homo sapiens
tcttgatcctagaaaagaggctgttcaggatggggaggatatttcaattgctccgggaccgaagaatctcctcacgtgggccaggccttcacacacccaaagcggaaccgcgtcggcgaaaaggattgacaaccggtctcatgacccaggcagagaggcagaaacaggctcaccaaagacaggccgccatgcgagaaacagctttgtggtgcacagggcacattcggccaaggacacacacgcacacgggcacacacacacaaaccgacagagagagggaaagaaacacacagagactgagagacagagagagaagagagaatgggagacacacacacatacacacacagacacacacacagagtcttatagcaaaggcattgaaagacacacacccaggcaacccctgaggctgtggggttctgctttcgacgagaaagacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgtttggccctttgtgactcttggcatccggagactttcccctcgacccagtggagtcgtcaggccggagcctcagagccttgacacccaagcactgccacggaagtctccccctttgccaagcctcggggactggtttctaagacaaccgtgggaaccactgtgacgggagaaaccgcttgtgcttcgcgcatgcgcattggctgggccgactccttctcccctcctggcagtcaggctgcgtccccttcaaagaacgccaccgctgagaactgaccctcacatctcccttcctgaatttctttagggaaagcaacaaccatccctgtaagccatgggttttcatgcggaggaaggagagggctagttgtctgagagggaaactgcttaaggctgcagactaggaaatgggattccaggtttaagatagctcctttctggacctcagtccttcacctagtcacctagtcacagggtggatcgcctctaaggatacttagtggaaaaggaaccaaattcgggatggttctccttgctttaagccttgatgggagacggggaggccaacccttctctgcagaccgtgatcctcactagacagaggagctccaaacctgcccatctcatcccatgcacctacggtgcctggcctggctccaaactcccgaaaggaactattttacaggtgccaaaaaggggacagtgttgataataataataaaatgaaacaatctga

SEQ ID NO: 6603 - DNA, 1395 bp, Homo sapiens
atgatggcatgtcgtgaccccaaacctggggcaaagagactggtgagagcccagaccctccagaagcagcggagagccccagttgggccaagggctcccccgcccgatgaagaagatcccaggctcaagtgcaaaaactgtggggcctttggtcacatggccagaagtaccaggtgccccatgaagtgctggaaggcagccctggttccaccgaccttggggaaaaaggaagggaaggaaaacctgaaaccatggaagccccaggttgaagcaaacccggggcccttgaacaaggataagggagagaaggaagagagaccaaggcaacaagacccgcagaggaaggctctcctccacatattttccgggaaacctccagagaagccgctgccaaatcgaaaaggatccacggaatcttctgtttatctgagggttgcaagcgggccaatgccggtccacacaaccagtaagaggccgcgtgtggaccctgtcctcgctgatcgctcagctaccgaaatgtctgacaggggctccgccttggcttcactgtctcccctcagaaaagccagtctgagctcctcctcaagtcttggaccaaaggaaagacagacaggggctgcggccgacatccctcagcctgcagtcagacaccagggccccgagcctctcctcgtggtgaagccgacacacagcagccctgagggtggctgccgagaagttccccaggctgcctccaaaacccacggcctgctccaggccatcagcccccaggcacaagacaaacgtcctgcggtgacctcacagccctgcccaccagccgccacacatagcttgggtctaggctccaatctcagcttcgggccaggagccaagagacctgcccaggctccgattcaggcttgcctgaacttccccaagaaaccgaggctgggtcccttccagatccccgaaagcgccatccagggaggtgagctgggggccccggagtatctccaacctccgccggcaacaaccgaacttggaccaagtacgtcgccccagatgggcaggaggacacccgcccaggtgtccagcgtcgaccggcagcctccgcacagcagaccttgcctgcctactgcccaggcctgcaccatgtcccatcacccagcgaccagccatgatggggcccagcctctcagagtgctcttccggagactggaaaacggacgctggagctccagcctcctggcggccccctcatttcactctcctgagaagccgggagccttcctcgctcagagccctcatgtctcagagaagtctgaggttccccgtgttcgtgtcccaccgaacgtcctctatgaggaccttcaggtttcctcctcctcagaggacagcgactctgacctggagtga

SEQ ID NO: 6604 - DNA, 1383 bp, Homo sapiens
cagatggcccgtcattccgtccatcatcaggctcagaggccccccagagccaaaaacccacaggagcagcagaggagacccatggggcagacgactctcccagcagagcaggaggaatccagggtgaaatgcaagaactgcggggcctttgggcactcagccaggagcaagacctgccccattaagaggtggagtggggcccttcctctgcaggccctgggctcacacaaggagaaggagaacctgaaaccagcaaaggcccagctaccctttacgactccagggccctttacgacgaatgacagagaaaaggagcgaagtccaagtccccagcagcagcagagcgaagctccgacgcagacatttcccagaactccccaagagaaaatgcaggaagcctggaaggagccagcagaagattgtttgttcctgaggcatcctaccatgccactgcctgtccacaccaccaagaagagatctgtcctgggccctgtgtccacaggtccaccgcctgtcaacaaacccgagatgagattactctgcccttcgggtcacaacgattcacctcaactgagcacctgtggacccaccaaaggacatggcagggacgttactgcctccctgctccctgttctgaagagctcccaccagacccccactctcagtgccaggctgccagccaacaggcctgacatgtcctcccatggtgctctccagcctgccatgcaggcgcttgccctgggtcctggccttaaatcccaggcagaaatcaaacatcccgacgcagatgcaaagcccagaccacagcaagtcagaaaacagtgtggccaggactccagaacccaggcaccagacaaggagcctgcccccgtccccacccagactttccagaaccccgcaaagaaagcaagattcagctccttccagacccctgcactgagaactcagctcccggatgtgggcgctgtgcagacactccagcctccccgcactgcaactggacttggatccaaagaggcacccaaggcgaccgcagagacagcagccaccaagacagcaaccctgcagcccagagtcaacctccagcccgcacccagctcacctttcctgggcccagcccagggctgccccgtcctccagcctggaccacccattcatgttccagggaggcccggcagtgtcaccttcatgagaggggacaagggacagaagagccccaggttcagaatgcctcccacatcccgtcctcctgaaaactctgcttctgctcagagccctcgcttctcaaggcagcctgaggggcagggtccccaggtctcaacgagtgtcctctatgaggaccttctggtcacttcctcctctgaggacagtgacagtgactga

SEQ ID NO: 6605 - DNA, 908 bp, Homo sapiens
tttgttctaggtgctgtctctcctgctgttgttgtcctttacacgatggtgttgcaagaaaatggatatggtgttgaggaagacattccaaccttactaatggctgctagcagtatggatgaccttctggctatcactggattcaatacatgcttgagcatagtcttctactcgggtggtatgattaataacgccatagcctctctaaggaacgtatgtattagtctgctggccggaattgttttgggattttttgttcgatattttccaagtgaagaccagaaaaaaattacattgaagagaggattccttgttttgattacgtttgtttctgctgtcttaggcagccaacctattggtttacatggatctggaggattatgcacactagtgttgcatttcattgaatggacaaaatggtcccaagaaaagatgaaagtccaaaagattattacaaatgtatgggatatttttcaaccacttctttttggtttagttggagcagaagtatctgtttcattgcttgaatcaaatattgttggcatatctgtttccactctgagtttggcattatgtgttcgaattttaaacatatatctattgatgtgctttgctggttttagttttaaggagaaaatatttattgctttagcatggatgcccaaagctacagtacaggctgtgttaggtcctctggctctagaaacagcaagagtctccacaccccacttggaaacatatgcgaaggatgtgatgacagtagcatttttagccatcatgatcacagctccaaatggagctctacttatgggcattctggggcctaaaatgcttacacgccattatgatccaagcaaaataaaactgcaattgtcaacattagaacatcattaaaaagtttacctgtc

SEQ ID NO: 6606 - DNA, 2758 bp, Homo sapiens
gccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagaatccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcatagta

SEQ ID NO: 6607 - DNA, 2682 bp, Homo sapiens
gcttttccaagtccagctgccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcatagt

SEQ ID NO: 6608 - DNA, 4700 bp, Homo sapiens
aggtggaccaggtgctctgaggctggcgtacagacacagcacgtgcgacggagtggtgttggtccgacaccacggggcatggggatacgtgtgcaaccaggagtggacgctggcagaggcctctgtcgtgtgcaggcagctgggctgcggccctgccgtgggcgcccccaagtatgtcccgctgcctggagagatggcccagccctggcttcacaacgtgtcctgccggggcaacgagtcctccctctgggagtgcagccttggctcatggtgccagagcccgtgcccccacgcatgggtggtggtcgcgctgtgctccagagaccagcagcagagcatgaagctgggcacaggggtctctctgagcccagggccctgtgtgactgcccggtcacctgcccctgaagctggccctggctcagcccatcactgtcctccctgaaaaaggagctgccgagtgaccatgcggccagctgggtccataccttaaggaggaccggcctgtgctccacagacggcactttccgggagctccggctggtgaagggccgcagtccctgcgcgggactccccgagatcagaaacgtgaatggggtggaccgcctctgtgtcctgcatgtggaggaggccatggtgttctgccgggagctggggtgcggccctgtgctccaggccccccgccgggacgtgggcgtcgtcaggaagtacctggcctgcaggggtaccgagcccaccatccgcagctgcagactggacaacaacttccgcagcggctgcgacctgcggctggacgcagaggtggtctgctcaggtgaggctgccacctgatgttcccagtgacccttgggatgatgctgggcccggacctggggagggcagggagaaggggggtgggcgttcccacggatgggcccccctgtcctgcatgagacattgggcgcagaggtgggaaagggcctcagctctcacgctggttctcagcagagtggagctgagtttctggtggccccacagaggtgtcctggctcagaacccgcaggccatctaggggtcctggctgccgctgcaagtctgagctgcctcagctgtgatctctgcatgtctaacatggatcggggttgggtagaggtcacttcttcccagccctgcctcaactgtgtgtgagctgcactggcctcacagctcctggccttgttgtgcatatgaggagcagctgaaatgaggtggatagtctgcctgctgcggtaccccagagagggtggtgctcagtggaccaaggggtgccctgacctcgcctctgggattgcagagggtgttgctgtcatggcctcggacaggcagaggctgtgaaatacgtgagcacctgcagcaggtgaccctgaccctgaccttggtgatgcggccaaggacgtctgctctgctctgggtgccgggtggaagggcctgtggctgcaagttcctgcctgtgcttggtagaccctctgcctagatgcaggtgatggctcctggctgaagccttccgcagtctgaggctcagggccaggctgttgacctgagaacacctgtctcctgcctgagaggacgtctgcccccaggacacaccgaggcccgactggtgggcggcgagcacccctgcgccgggcgcctggaggtgacctggggcaccgtctgtgatgcggccctggacctggccacggcccacgtggtgtgccgggagctgcagtgtggggcggtcgtgtccacgcccgagggcgcccgcttcggccggggctcggggccggtgtggacggaggccttccgctgtgcgggcaacgagtcgctgctgttccactgcccacgggggcgtgggagccagtgtgggcatggtcacgacgcggggctcaggtgctcagagttcaggatggtcaacggcagcagcagctgtgagggccgcgtggagttccaggtgcaggggtcctgggcacccctctgtgccacccactgggacatagcagatgccaccgtcctctgccaccagctcaactgtggcaacgcggtggccgcacctggaggaggccattttggggacggggacgctgccatctggcctgatgcctttcactgtgaggggacagagtcctacttgtggaattgcccagtaagcaccctgggggccccggcctgtgccccgggaaacacagcctccgcggtctgctcaggtctggcccacgccctgcgactgagggaaggacagagccgctgtgacggccgcgtggaggtctccctggatggcgtgtggggccgcgtcctggacgatgcctgggacctgcgcggcgcgggcgtggtgtgccggcaactcgggtgcagaggggcccagcaagcctatgacgcacctgcccccagccgcggatccgtccaggtggcgctgagccgcgtgcgctgtctgggcaccgaaacccgcctgactcagtgcaacgtgtccgcgaccctgcaggagcccgcggggacctcgcgggacgccggcgtggtgtgctccggtgaggtcggaaccgcgtcccccatggcccgtcgccacgggatcccgggcgccctgactctgtctctccacagggagcctcagggtgcggctggccgcggggccggggcgctgcacgggggcgcgtggggcaccgtgtgtgacgatgcctgggacctgcgggacgcgcacgtggtctgcaggcagctgggctgtggccgcgccctgagccctgggggccgcacacttcggagccggggcagggcgcatctggctggacgagctgggctgccagggccacgagtctgcgctgtggcagtgcccgtcggcgggctgggggcggcacgactggaggcacaaggaggacgccggcgtcttctgctcagagtcggtggctctgaggctgcgaggtgggacctgctgctgtgctgggtggctggacgtgttctacaatgggacctggggcgccatgtgcagcaatgccctgaaggacctctccttgtccatcatctgcaagcagctggggtgtggggagtggggctggctggagaacaggcccttcccctctgcgggcaccgggaccgcctgggtggacaacatcgagtgccgcaggctgcccaactccactctgtggcaatgcccttcccacccatggcacccgcactcttgcgaccttcgagagcaggtctggattacctgtgcaggattgtcagaggacaggccacaggctgctggggagcccctcaactgctcctcctggctcggctgcccagaggagggcgcactgcgcgtgcgcgggggcgaggaccgctgctccgggcgcgtggagctctggcacgcgggctcctggggcaccgtgtgcgacgatggctgggacctggcggacgcggaggtcgtgtgccgccagctgggctgtggtcgggccgtcgccgccctgggggccgccgcctttggccctggctccgggcccgtgtggctggacgaggtggggtgccggggcagcgaggcgtccctgtggggctgccccggagcggtggggacgcggagaccgcgcgcacgaggaggacgcgggcgtgcgctgctgggaaaacaaacagttaaccacagtgatgaccttagcaaaagcagcagcagtgagcctggcccaggccccccactgcctgcagctcccttccggacattctgggtggtcagtgtcgtcctgggatcccttcttggtcttctccttctgggcctcatggcttttctgattctgcctcgagtcacacaagccatgcagaggggtctgggaagatccgaggtatctcctggagaagccatctatgatgtcattggggaaatgccgccagcaggactgtacgaggaaatcatggaggccgaggctgtgctccaagatgaggaggacggaagtgtggtgaaggtggacacagaagccgcaggctgaagtacagtggtgtgatctcggctcacggcaacctctgtctcccaggttcaagcaattcttatgcctcagcctccagagtagctaggattacagaaagaaagaacaaaaaagagaaggagagtaaattcttgtttccaagttagacaagagagttatgattaaatgccaccttgggtccacaagtcttccataagaaaaacaatgaaaggatttctggatgattctattatgacatcacaacttgcagcagaggcagatgtaatgaggcaatacttgacattgttttcagggcatttgctcgtgtcctcggtctcttgccttggcacctgggtggcttgccacccacagcaattgtgactttgaaaggccattccaccgttctatcaatccagctgcttcaggatgatgggcaacgtggtaagaccagtgaattccacgaacatgagcccactgctgcacttctatggccgtaaagatagacaagagaagcacttctagaatggcaggataagaagctctgaaaatctgttcctccagaactgcaatgtgaacaccagctaaagtgttgaaaaatgaatggagcctcagagacctttgggacatcatcaagggtatctaacaggtacaatgggaatcacagaaagagagaaaataaggggacaaaaatactatttgaagaaataatgggtgtaaattccccaaatttgatgaaaaagatccatctacatatccaaaagcttaataaatgaatattcatttatt

SEQ ID NO: 6609 - DNA, 1437 bp, Homo sapiens
gggaaccattaaaagaactcagggaaacatgaattctggaatcttacaggtctttcagagggaactcatctgccccatctgcatgaactacttcatagacccggtcaccatagactgtgggcacagcttttgcaggccttgtttctacctcaactggaaagacagcccatttcttgtccagtgctctgaatgcacaaagtcaacagggcagataaacctcaaaaccaacattcatttcaagaagatggcttctcttgctagaaaagtcagtctctggctattcctgagctctgaggagcaaatgtgtggcactcacagggagacaaagaagatgttctgtgaagtggacaggagcctgctctgtttgctgtgctccagctctcaggagcaccgggatcacagacactgtcccattgagtcggctgctgaggaacaccaggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcaccatgaagaagaaaaacataatttggagatgctgaaaaagaaggggaaagatatttttcatcgacttcatttaagtaaagccaaaatggctcataggagggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacagtgatatctttctatgtgaaattttgagaagcatgtgtattggatgtgaccatcaagatgtaccctatttcactgcaacacctagaagttttcttgcatggggtgctcagactttcacctcgggcaaatattactgggaggtccatgtaggggactcctggaattgggcttttggtgtctgtaatatgtattggaaagagaagaatcagaatgagaagatagatggagaggatggactctttcttcttgggtgtgttaagaatgacattcaacgcagtctctttaccacctccccacttctgctgcaatatatcccaagacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcc

SEQ ID NO: 6610 - DNA, 693 bp, Homo sapiens
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggaggtaataactgcctctcactgcaagtcaaccctgtacaaccagccagatatttgtggacaacacttcacagctcaaaacaaggtgaacctaactcctcagcaaaccacagatgctcctgaaagtctccaaggccagaagaaaacccctaaacatataccacactgtggcaactgtagcctagaaggtaacgaatgaagaacacagcaaatatctgagagttgctgcctgaagacacaggacaatgacctcagaaggatggggatgggctggaaaacctctggtctctaccctccttacagctgtgatttgcttctccctaggaaggtcctgcttccatgcttctccccataccccactcacttgagtgtctcacacgggatggtaactagatgtaacacttgccaaggggtcattatcacctactaaatacaaatagatgtctagcttgtctgtccacagagaggtgaatgatg

SEQ ID NO: 6611 - DNA, 2582 bp, Homo sapiens
caggtcctggccatgccatcggcaacctgctcgtcttgtccgtgaggccttcccagctggccgggctcaccctgcagctcctgcacctgtgcctgcccggggaattgtgggccgtttcccactcctcttcaaccgtcagcgacatcttgggccttcttttccagtcaggtgggacggcgcccctatgaggctgtgtcttatccctcggaacacgggcaccccacagagggtcctgcgtcctgtggtctggagccccccctcaaggaagaaacccgtgctgtctcctcacaactccataatgtttggacacctcagccccgtaaggatcccttgtctcagaggcaagtttaaccttcaacttccttcattagatgatcaggtgatcccagccaggctcccgaagacggaggtgagcgcagaagagcccaaagaagcaacagaggtgaaagaccaggtagagacccaggggcaggaggacaataaaaggggcccctgtagcaatggggaagcagcctccacctctaggcccctggagactcagggaaacctcacttcttcctggtacaatcccaggcccttggagggaaatgtccacctcaagagcttgacagaaaagaatcagactgacaaggcccaggtgcatgcagtgagtttctactccaagggccatggagtcgccagttcacacagccctgctggaggcatccttccctttgggaagcctgacccacttccaacagtgctccctgccccagttccgggctgctccctgtggccagagaaggcggccttgaaggtgctgggtgaagaccacctgcccagctctccaggcttgctgatggtgggggaggacatgcagcccaaggatcctgcagctcttggatcaagtaggtcttctccacccagagctgccggccacaggtcccacaaaagaaaactgtcggggccaccgctgcagctgcaaccgacccctcccctgcaactgaggtgtgatagagacgagcggcccccaccggcaaagcttccatgtctatctcctgaggcactgttggtgggtcaggcttcccaaagagaaggacgcctccagcatggcaacatgcgtaagaacatgagagtgttaagtagaatatcaaaattcaggagactaagacagttgcttaggaggagaaagaagacacggcagggcaggcgtggtggctcatgcctgtaatccagcactttgggaggcccaggcgggcggatcaggagatcaagagattgagacctgaggagcatctctgcctgcaccatctgggaagtgaggagcgcctctgccctgctgctccaccatctgggaagtgaggagcgcctgtgcccggccaccgcaccatctgggcagtgaggagcgcctctgcccggcccccgccctgtctgggaagcgacaagagcctctgcccagcagcctcacagtctgggaagtgaggagcgcctctgcccaggccctgccccgtctgggcagtgaggagtgcctccgccaggccgccgccctgtctgggaagtgaggagcgcctctgcccagccaccgtcccgtctgcgaagcgaggagtgcctctgcccggcccccctacactctgggaagcgaggagtgcctctgcccggcccccctacactctgggaagtgaggagcgcctctgctcggccaccgccccgtccgggaagtgaggcgcgcctctgcccagccgcccactatctgggaattgaggaggagcgccgcctctgcctggcctccaccccatctgggaagtgaggagcacctctgcccagctgcctcacagtatgggaagtgagaagcgcctctgcccagccgccgccccatctgggaaacaaggagcgcctctgccccgccgccgtcctgtctgcgaagtaaggagtgcccctgcccggcctcctcaccgtgtgggaaatgaggagcgcctctgccccgccgccgccccgtctgcgaagcgaggagtgcctctgcccagcctcctcaccgtctgggaaatgaggagcgcctctgccctgccgccgtcccgtctgcgaagcgaggagtgcctctgcccggcctcctcaccgtctgggaaatgaggagtgcccctgccttgccgccgtcccgtctgcgaagcgaggagtgcctctgcccggcctcctcaccgtctgggaaatgaggagcgcctctgccctgctgccgtcctgtctgtgaagtgaggagtgcctctgcctggcctcctcaccgtctgggaaatgaggagcgcctctgcccggccaccgtcccatctgggaagtgaggagcgcccctgcccagccgccgccctgtctggaaagtgaggagcacctctgcccagccccctcaccatttgtaagggaggagtgcctctgcccagcccctgcaccgtctgggaagtgaggagtgcccccacccggccccctcaccatctgggaagtgaggagggtctctgcctggctgctgtgcaaccttccaagtgtgaagtgacagccttgtgtgtgatctttctgccctccccaggtttgcattttcgacattaaagtttactttttaattt

SEQ ID NO: 6612 - DNA, 2541 bp, Homo sapiens
ggcactgactgggtcactggtgaagttccccgcaggaactgagtcagaccccatctcagggccctgcacaagataggtacctgctctaaggcgtggaccctcgccacagccctggcccgtcttgacgggcgagggttactgtacttgtcccaaccgtacagatgagaaagctgagactcagggccagcaacccgggtcccagcggagcgcccggcacgcgccaacacttcagcaccagtcgcggtggccaccactgtgcgcggagatggctgcgacgcgtgcgcagatctcgatcccaaactccctcctaccagaatctggacccgaatccacccattgtccgttttccgctgccgctggagagaatctctgaggtccccaggagagcctgcctgcacggaagagacgcctcctcggtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacatagttgtaagagctagttattttagacaatgcctctgtgatcagggactctaatctggaaataggtagtcggagaggtcggtgatgcagtctctggatcagagacctgagctatatggggttagagaggggccctgggcaggcgagtctctggggagtgtggtgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgttattcgcctctcattatttaaataatttgaagttttccccaataactagtgtcttagaagtcatgaaaatttcagaaaatgacaggtcttctgagttcatgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgcgaatggcaggcattcagatctccaagaatagaggattaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttacatgctatggaggtctagaaattcacattatggtggcaggtgacagacaatacaaagagataaagcaattttatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaa

SEQ ID NO: 6613 - DNA, 3343 bp, Homo sapiens
agccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtctccaacaacatctttccttgctctttcacaactctccccctttttagaaaacttccagtcacgctttaataagaagagaaagggcctgtatcgcaaggctatcacagaggcagctaaggctgccaagcagctgacccccgaagtgcgggctttgttgacacagtttgaaacgtgaacatgggcagtaaggtaggcaagaccattggaagtcaccacagattttctagtctagttaggaataatttctacaaaatagcgtggccagattggagagagaagttgcactcagttggctggctttttaatacttaccttatagccatttttagactgagagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtgtgtatatatatatatccgtgtatgtatatatacacacatatatatgtatatatacacatatatatatatgaaatacagcctgtcactgtgtgacacagattgcatatttgggattgcaataagggcttggtgagctgggggaatagtggatatttaatgactacttgttttttaaataatgaacacttagcctttctatgcgcataatggtgtaaaagttagatggttaggtgtttgacaaacagatggttgcaattcagttacagactggggaaatagcccagtgtttgggattaaaactgtcaagactggataggtgttagtcatcactgtctttcgtccagtggggatttaataaatactttcaagcttctggtttgggagtttagataggtttgattttggatttgtaaatagtgattgctaaatttggtcagatttctcctgactggctgttcctaaattcttaggatatgtcccagtaaaattatactttgtgaattaattgtcatatgtgtaattgttgcattttggatgtacctaatttgataattaaaacaaaataatttccgtttaaggtatctgtttgcaggtcagaaaatgagaaaatgtaattgtgtaatgctctgaaatgtaaaaaaaaaaaaaaaaaccaaaaaaaagctgtaaataaaatcaactaaatcc

SEQ ID NO: 6614 - DNA, 2358 bp, Homo sapiens
agccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtctcaacaaatggcagctattacatcagacagtgacgagtcctgctgctcccttacagtgtctgacagaccactgtggattcagactgggagcattgaagttaacagtgaaacgggcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaa

SEQ ID NO: 6615 - DNA, 1819 bp, Homo sapiens
gccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatg

SEQ ID NO: 6616 - DNA, 2651 bp, Homo sapiens
ggcggcggcggcggcggcggcggcggcggggcgggggcggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtaagatccatggttttccttggtggccggcgcgtgttcttgacatcagtctcggccagaaggaggacggagagccgtcttggcgagaagcgaaggtctcgtggtttggttctccgactacgtcgttcttgtctatttcaaaactctcccctttctctgaatttttcaaactgagatttaatcgtaagaagaaggggatgtatcggaaagctataaccgaggctgcaaatgccgcaagacacgtggccccggaaatcagggagctcttaacccagtttgaaacgtaactggttccctgaccaggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaa

SEQ ID NO: 6617 - DNA, 2285 bp, Homo sapiens
gcgggggcggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagacc

SEQ ID NO: 6618 - DNA, 1538 bp, Homo sapiens
tgcaaagccgacggatagaacctgtgatgggaagacttctgctctgcgcttctcatggggagatagaaaagcacccgagccttcatgcctcgagctatggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactct

SEQ ID NO: 6619 - DNA, 2190 bp, Homo sapiens
ttcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccgcgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactct

SEQ ID NO: 6620 - DNA, 3169 bp, Homo sapiens
cagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaaaaa

SEQ ID NO: 6621 - DNA, 1042 bp, Homo sapiens
gtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagtgtaaggt

SEQ ID NO: 6622 - DNA, 2028 bp, Homo sapiens
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgcgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatgtggccgtagacaggctgcccagcttcctggcggcccccaatgctcccaggggccagccgctgccccatcaccaatgctccatccacctgaactgtgaagacaccctcctccttcatcaggcctttgaagatgccatggatggcctgccttcccacaggcctgtgattgagctctgcatcccttcctcgctggaccccaccctggctccccctggctgccatgtagtctccctcttcactcagtacatgccctatacgctggctggaggcaaggcctgggacgagcaggagagagacgcttatgcagacagagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagatta

SEQ ID NO: 6623 - DNA, 995 bp, Homo sapiens
ccaggcagagaaggtgcccggagctcagagcgcgcagagcccggccgctgggccgctgcctgagccagggaggcgcagcgcgagctcccacttcgtcttcatggattcccagcccagctgcgtggtggtgactgcatgttttcaaggttgagccacgtggtagtgtgtccagaattggtgggttgttggtctcactgacttcaagaatgaagccgcggactctcgtggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacagggga

SEQ ID NO: 6624 - DNA, 1483 bp, Homo sapiens
agtagcaacttgctggagtcgccttctgtgctgtggaagttttgttgttttgcttgtttgcaataaccgttgctgctgcttactgtttgggtccgcactgcctttatgagctgtaacgctcaccgtgaaggtctgcagcttcgttcttaaagccagccacatcacggacccaccgggagaaacgaataactccaaacacgccaccttaagagccgtagcactcatgatgaaggtccgtagcttcactcctgaagtcagcgagatcacgaatctgccagaaggaagaaactccgaacacatgcgagcatcagaagaaacaaacttgggacacgctgcctttaaaaactgtaacactcaccgccagggtccgcggcttcgttcttgaagtcagtgagaccaagaatccgccgattctggacacaccatgacggaactagatccttggcctttcggggcccagaacgctacggacgccgggcggccaggaggggttgggctcccgctccaccccggtccccggcgagcacgcggccaggcagagaaggtgcccggagctcagagcgcgcagagcccggccgctgggccgctgcctgagccagggaggcgcagcgcgagctcccacttcgtcttcatggattcccagcccagctgcgtggtggtgactggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacaggggatgaactagcttcagttatggttttcatgacaataaaatgaaatccgagtc

SEQ ID NO: 6625 - DNA, 1483 bp, Homo sapiens; identical to SEQ ID NO: 6624

SEQ ID NO: 6626 - DNA, 2678 bp, Homo sapiens
ctagatctgtgggcggggcgcggcctgtggatgggcggtgagcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttcaccagaggtggataaaaccaagttctgggctgggcccagtggctcacatctgtaattccagcactttgggaggccgaggcgggcagatcacaaagtcaggagtttgagaccaacctgaccaacatggagaaaccccatctctactaaaaatacaaaattagctggatgtggtggtgcgtgcctgtaatcccagctacttgggaggctgaggcaggagaattgcttgaatccaggaggcggagattgcagagagccaagatcatgccactgcactccagcctgggtgacagcaagactctgtcttgg

SEQ ID NO: 6627 - DNA, 1324 bp, Homo sapiens
agcggcgtccgaggcaacaagatggcagctgcggagccgtctccgcggcgcgtgggcttcgtgggcgcgggccgcatggcgggggccatcgcgcagggcctcatcagagcagccatacttcagggtccagaagagtcaagatcaatcgggaaatagcttactatgagtctcaggagtcttccctgtgaaacctggcagtaccgcatgcctcccagagctgtacaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcac

SEQ ID NO: 6628 - DNA, 1773 bp, Homo sapiens
tgtctgggtctcggttttgccatgaatatgaaagctagtcgtgtcactctaggagaagcggtttgtgttggtggcaggtgcgccccctcccaataggtgacaagaacacgcactctcccgttcctgcgttacctcccccaggccgcgcggtggcgctgcgtctctgcagcggcccgggtctctctagggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtga

SEQ ID NO: 6629 - DNA, 1624 bp, Homo sapiens
atgaatatgaaagctagtcgtgtcactctaggagaagcgggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtg

SEQ ID NO: 6630 - DNA, 1489 bp, Homo sapiens
tgtctgggtctcggttttgccatgaatatgaaagctagtcgtgtcactctaggagaagcggtttgtgttggtggcaggtgcgccccctcccaataggtgacaagaacacgcactctcccgttcctgcgttacctcccccaggccgcgcggtggcgctgcgtctctgcagcggcccgggtctctctagggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctgg

SEQ ID NO: 6631 - DNA, 781 bp, Homo sapiens
gtcgtcccgacccccgggctcccgggtgggaaggagcagctgggctgcgcggagcaggcccccgtgagccccgggaaggagcgcagcgcagggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaa

SEQ ID NO: 6632 - DNA, 985 bp, Homo sapiens
gccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaatcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggta

SEQ ID NO: 6633 - DNA, 953 bp, Homo sapiens
gccctttcggtgccggcgttgcggggtcgcgggagatccgggggtctgtgctctgattcccggccctgcccgtctctcttacaggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcagga

SEQ ID NO: 6634 - DNA, 4648 bp, Homo sapiens
cggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcagcggccattgcagtcatttggacagacaggaaaaaggtctaagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatatag

SEQ ID NO: 6635 - DNA, 4257 bp, Homo sapiens
cggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaat

SEQ ID NO: 6636 - DNA, 1809 bp, Homo sapiens
cccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggc

SEQ ID NO: 6637 - DNA, 2428 bp, Homo sapiens
agcagctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtacagacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 6638 - DNA, 2169 bp, Homo sapiens
gctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 6639 - DNA, 2140 bp, Homo sapiens
tgcggcgcgagctgggccggcgggcgtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaaca

SEQ ID NO: 6640 - DNA, 1130 bp, Homo sapiens
tccgtcgccatggaaacgaaagcggccaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattccca

SEQ ID NO: 6641 - DNA, 1785 bp, Homo sapiens
atggaaacgaaagcggccaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaaaagccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaa

SEQ ID NO: 6642 - DNA, 875 bp, Homo sapiens
caagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaa

SEQ ID NO: 6643 - DNA, 917 bp, Homo sapiens
gtcctgacgcgccgcctcccgtgggctccggccggctaagccgcggcggacaactatgctgaaagccaagatcctcttcgtggggccttgcgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattca

SEQ ID NO: 6644 - DNA, 1657 bp, Homo sapiens
aagtagagctccgtcctgacgcgccgcctcccgtgggctccggccggctaagccgcggcggacaactatgctgaaagccaagatcctcttcgtggggccttgcgagaccttgattccaaccactgcccggaggaggtagtggaggcgagcccggtgttaatgagccccgaaggcccaagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaaaagccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcccgggagacagaggttgcagtgagccaagattgcgccactgtactccagcttgggcaacagagcaagactccatctc

SEQ ID NO: 6645 - DNA, 2125 bp, Homo sapiens
ctggtggggggaagaaggctcctgctacctcccttcccggcaccctccagagggaccctcagtctggccttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 6646 - DNA, 2284 bp, Homo sapiens
cgagcccaggcgtctgagacctactgaccggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcggcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 6647 - DNA, 1950 bp, Homo sapiens
aagaaatgagtgaggtggatgcttcagcgctgttagtctcctccccatgcccctcctcacttcatctagtttagtccctttatcctgtgaagtaggggtcatcattagcccccttttacagaggagagaattgaggcttcgagagagagaaacttggccaggagtttccactcggtccgacgccctcggtgccccgccgggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcatggtggctcacgcctgtaatcctagcatttttggaggccaaggacagtggatcacctgaggtcaggggttcgagaccagcctggccaacatggtgaaaccctgtctctactaaaaatacaaaaattagccaggcgtggtggtgcatgcctgtaatcccagttactccagaggctaaggcaggagaattgcttgaacctgggaggcagagattgcagtgagccaagactgcgccactgcactccagcctgggcaacagagtgagactctgtttcaaaaaaaaaaaagaaaagaaaagaaaggcctgagagaccagatgtgcaacttcctgtccttgagcctcagtgtccctatctatcgatggggctcataaaagatcccaccttgaagggaggtggtgaccacaaatgagacagtggacaggatgtgctcacccagagcctgccgcgctgtgaattgaatgacaaaagctctcattcccactccctttttcttggctgcgatgtggccactctggcagcattcctgggctcagacactgagaagccagcgtcaggaagctgatgcatgggcaaaggcaggtgcggggaattccagggggagcttggcttggaggcttcttatgtcctcaggctaaaatgattctgggcatgggattaatatgtgacgtcaaacccagggttgctggccaatgcccccccgaccaggcccaggggctgaaaaatggatgttggaggctgggatgaacatgaatgtgtagcaactatgttgggcacacagtggccactgtgatgagccaccaagatccccctttctggctggggaacccatcaaccctctccccagctgctggagtgccactggatgatggacttcagcttgccccactctctgggaaaggccctcccttcagggcagcttgtatccaaagttcatctcctggggggccttaaaggactccctcttgccccagctctggacaactctgaaagtcaaaaccaactttatcagtctctgtgggcttcattgaggacactgttgtgacatcatagccaagttatccccttgcccaatcctgcttccttttcttccccaaacaggtatccatttcaagaatatcccctaataaacatctgcacactca

SEQ ID NO: 6648 - DNA, 462 bp, Homo sapiens
atggctggagggggaccccaggccaaccctgattacctcttccatgtcatctttctgggagactccaacgtgggcaaaacatccttcctgcacctgctgcaccagaattctttcgccaccggattgacagctaccgtgcttcacccctctctatgtgtcctaggagtagattttcgggtcaaaaccttgctggtggacaacaagtgctttgtgctgcagctctgggacacagctggccaagagaggtaccacagtatgacgcgacagctgctccgcaaggctgacggggtggtgctcatgtacgacatcacctcccaggagagctttgcccacgtgcgctactggctagactgtctccaggatgcagggtcggatggggtggtcatccttctcctgggaaacaagatggactgtgaggaggaacggcaagtgtccgtggaagctgggcagcaactggcccag

SEQ ID NO: 6649 - DNA, 1671 bp, Homo sapiens
agatccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaa

SEQ ID NO: 6650 - DNA, 2809 bp, Homo sapiens
ccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccatgggctggcccaggaccgtgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatctgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaa

SEQ ID NO: 6651 - DNA, 3060 bp, Homo sapiens
gaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 6652 - DNA, 2943 bp, Homo sapiens
cgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 6653 - DNA, 2789 bp, Homo sapiens
agcccgggtagggccaggtggctgccctttcacctagggtagtccctggtcgcctccgctcttcgcccaaaaggggatgcagctccgggaaatatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 6654 - DNA, 3724 bp, Homo sapiens
gacagatcctttccattcgctgtcatgtctctccctcagcccacgccgcggatggccgagctcagaaagcctacctcctctttaacgcctcctgaggacccggattcccaaccacctagtagcaagcggctctgtcttgaggagcctggaggtgtctttaaggcgggctggcgactgcctctggtgcctcgcttgtctgaggcggaaaaagtctgggagttgtcccctagacccttcaagggactccttgtttcaacgaatgctattttcgataactccacagactcgtgtgtggagaaatcagtcagtgggaagcagatatgtaatctgaaatgctcaaatctcaaattccaaatgagtagctgtttgcagtctcccccctcacaaagtcctgattctgatttgagggcttcaggaaggtctgaggcaggcctgcatgacagagaggctttcagtgtgcaccgcagtaatagctccaaagcaggggttagtcaacttctgcccagcacctctatacacgatatacatggaattagaaatgagaatcgaaaacaacagtttgtccaaggaagagacaatgttcacaaagaaaatccatttttagatgttaccttttacaaggaaactaaatcaccatttcatgaaattaagaacagatgtaaagctaacagtgttgtgccatcaaataaaagagaaaataacatttcatcatctgtactaaaaatatcaaaatctcaaaaccagcccagcttggaaattgccaaacctagctattttagagatagcggcacaataagtgtccctcagtttccaatggacttaaatagcaaaatgtcctctgtctatttaaaggaaatagcgaagaaaaagaatgacaaaaaagaggcatatgttagggatttcacaaacatttactggtcccaaaatagacctgatgttaagaagcaaaagttacagaatgataaaaaaactgtagaagcggaaaacattttttccaaatgttatgaaaatgactacccatcactcagtagccaaaatacttgtaagagaaaagacttgatcagttcaaactactgtaactgcagtagtatccagtgtaatgtaagagactctagaaagaatttcgctatactagaaaatgcaaattgggaggaagcagaatgtctggacagttacgtacttaccaggctggaaaaatctcaaaactgggactgtaacgttagacatattttgagaagaaatagaggaaattgttggattataaataattgcaagactaaatgtgaaaatatgaaaaaaactgaagaaaaatggaattggctattattattagaaatagaccttttaagcaaggaagattaccactgtgcaaaagtcatcaatgcatatgaagaacaatcaaagcttctcgtaagagaaatattaggtagtcagacagctttaataacgactgtttggctaaatggtaaaggagaaaatgataatactctacagttgagatacaatactacacaaaaagtctttcatgtgaacaacccttttgaaagtttcattatagaaattttttatttccataaaagtatttcaggaaataaaaaagataatagtattttaacctgctgtaacattttgaagtgtaaaaagcaaattggtataattggtattcaaaatctaataaccagaaacatgaatacaaatataaagaatggaattttaagcatatatttacaagatagtgtttcagaacctttagatattctattgaaaactaacatagcttttttgctcaataactttgactctttaacaagaattgaaaatgattttgaattagaagaggaatgcattttcaagtgcatgctttatttgaagtatccaaaaaatatagtggaaaatcatactgcatatctagtaaagattttaacttcttcaagactattagaagataatatgaaacctatgttaaagaaaaggaagttatttagaactgaacaagtttttgaaaagtctaagaaaaaactcattaattccttcagtatgacaactcaaaatacaggttttccgatttttgaaacatatgaaaaaattccccttttaatggactttgatgacatggatgaaatttctttaataagagaaattacttgtcagaatatgagttgtcctcaacaagttgtgaatgtggaaaattgggctcactataattctagtactgttaaagcacatggtaattcttgtcctcaatttatacagaacaaccgaggatacattaatgaaaatttttatgaagtaaatatgcacagccaagatttaaatatggaaagaaaacagggacataataagatcagtaactttgactgtgagcacatatttgaagatctctgcaatgttaggcaacaggccataccagcaagccacaacataatacataatgaagagacccataccacttctataactcaagtactaaatttttggaacttgctaagtgaaatagaagaaaaaaaatatgacttaattttgaaagaggaagtaaaagtcacagctgaaagtttaacaaatagttgccaagttcacaaagatactaagatagaaaaggaagagaaagatagtttttttccaatggatgacatgttttctgtacagtcagtttcattaataagtaaggaagtaaatgtggaagaaaataaatatgttaatcaaaattatgtaacaaatacaaatgaatatgagagtattttgccagaaagggagatagctaattcaaaggattttcacagaaagaatgactctgcattatatattaatcatcaatttgaaactggtctgagtgaagggaatgatgaatgttttcaggacttagctgctaaatatttatcaacagaagctctgacaatagtaaaagattttgagatgaagagaaaatttgacttagtacttgaagaacttcgtatgtttcatgaaattagtagggaaaatgaacttctaagcactgtggaaacaaacaatgggcaagaaaattactttggagaaaatgatgctgagaaggtaaaaatggagatagaaaaagatttgaaaatggttgtggtcaacaaaatacgtgcatcttcctcgttccatgatactatagcaggtcctaatatgggcaaaagtcaccaaagtttatttaaatggaaaactgtacccaataatggagaacaggaagttcctaatgagagttgttatccaagtagatcagaggaagaattactttactctacttctgagaaagattgtgaaacacctttacctaaaagacctgcttttctccctgatgaatgtaaagaagaatttaattatttattgagaggaggtagtcactttccacatggcatttcaagagtacgaccgcttaagacatgcagtaggccaatcaggattggtttgtcaagaaaagcaaggattaaacaacttcatccttatctgaaacaaatgtgttacggaaacttaaaagaaaatttttgactttcatatttcaaaacattttacaacatctagaaatgttttgttttctttggatatatgttcttccagcttgggggtttggggcttgctttattataaagtggagaagtttttttttttgagtgtataaattatggtattacctttcaaagttataaaatattttatggatttttatatgatataaaaatgtacacattaaagccgtttcattattgga

SEQ ID NO: 6655 - DNA, 2175 bp, Homo sapiens
ggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttct

SEQ ID NO: 6656 - DNA, 1887 bp, Homo sapiens
ggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttct

SEQ ID NO: 6657 - DNA, 3152 bp, Homo sapiens
acgtaacagagctgggagcctggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctcaaaaaaaaaagaaaaaaaagagagagaatgcctaaacgttgtgctactgaaagccacagtgctcccttcctgcaaggaccatcttcaatattcaagtaaggcttaaggaattcagtggattagtatatgctctcatctattttttcacattcctactatgaaaaaatttcaggcaatgccaataaagcaaaagtccctgtttgccctcatacagtctcactcccctcctcaaaggtagatcactgttatcaggtatgagctatctaggccttttttgaggtattcctatacaaatgtatttgaaaatctagaaatatatagcttgattttctttatataaatataaacattatttacatattttatttttcacttaagagaatgtcttagatctttcaaggttagtggcatcaatctcttatcttgtcaaaatatggttaaggtattacatattatgactgtgctgtagcatagggaattaacatttgactttttaatctgaatgtgttagagaatttacctgcagtattaaaatcacaagttattttctctcc

SEQ ID NO: 6658 - DNA, 1904 bp, Homo sapiens
gatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctc

SEQ ID NO: 6659 - DNA, 3042 bp, Homo sapiens
agagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 6660 - DNA, 2158 bp, Homo sapiens
tcagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcact

SEQ ID NO: 6661 - DNA, 3106 bp, Homo sapiens
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 6662 - DNA, 3222 bp, Homo sapiens
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctggtaactaatttttcagactttgtcaggagaatgataatgacattgtgttgtaaaactgaaattttaactacaaatgaaaaccccaagtgtttggagacgtaatttttatttttcagataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 6663 - DNA, 2675 bp, Homo sapiens
ccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtg

SEQ ID NO: 6664 - DNA, 448 bp, Homo sapiens
ggctcctggagcgaggtgagcgccccaggccgcggtcctgcgtacgccgggacagccatggcgactgggtcctgctccttcccggccggactgacgcggcctcccaggacccgagcacgtgcgtgatgggcgaggagggcctaggccgggcagaccagtgcagggagccgattcttcccggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagataaaactcatcagtgctttgaaacaagcagctctgaaccaaagaaatcatttgattcaagtaaccattggatcttcccaaggcaatggtgaaagaaa

SEQ ID NO: 6665 - DNA, 2881 bp, Homo sapiens
ttcagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccagcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagtaaccacctaagttcgatattggctttctatttacaggcactttgattttaattaaagaaaggcaggatattccagctgtgatatgcaaataatcaggactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtggtggtgtgtacatgtggttctagcttcttgggaggctgaggtgggaggattgcttgagctcaggaggttgaggctgcagtgagccattgcattccagcctgggtcacggagctggtggccagtgtaatctataaataggcagcaggagagagactcaacaccaaaccagaattttaaaaacttttaacaatttattagtcttattttccagtaaaatattcacataatgtcaaaagaatgaaatgatagcgatatagccaactacctttaattaattccacataaatatttaaaatctaaaaacctcagatcagcagaccgagtcgaaatgtgattcttcaaagcaagtattgctttacccttgtcctgaatgcagtccgtcatatgaccactaacttgcatgtgaccaaatgtttgcagagtgttttttagatatgctctcggtgagccgtcatccgtcaatccaagaagaagatgttgttgaactgcgttgcacaaagtttcttgacctcttctgcaacaaggacacaacagtgaggaaggaagaggcagtcacttaaaaggttacatgatatataattaaattcttcttgggt

SEQ ID NO: 6666 - DNA, 646 bp, Homo sapiens
gggacgccgagagcccggcaacacctcagcccgagcccggcgaggtctctgggctcctggagcgaggtgagcgccccaggccgcggtcctgcgtacgccgggacagccatggcgactgggtcctgctccttcccggccggactgacgcggcctcccaggacccgagcacgtgcgtgatgggcgaggagggcctaggccgggcagaccagtgcagggagccgattcttcccggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggaga

SEQ ID NO: 6667 - DNA, 3042 bp, Homo sapiens
agagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 6668 - DNA, 2595 bp, Homo sapiens
ccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccagcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtg

SEQ ID NO: 6669 - DNA, 3220 bp, Homo sapiens
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctggtaactaatttttcagactttgtcaggagaatgataatgacattgtgttgtaaaactgaaattttaactacaaatgaaaaccccaagtgtttggagacgtaatttttatttttcagataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccg

SEQ ID NO: 6670 - DNA, 3106 bp, Homo sapiens
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 6671 - DNA, 596 bp, Homo sapiens
gagagcccggcaacacctcagcccgagcccggcgaggtctctgggctcctggagcgaggtgagcgccccaggccgcggtcctgcctacgccgggacagccatggcgactgggtcctgctccttcccggccggactgacgcggcctcccaggacccgagcacatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaa

SEQ ID NO: 6672 - DNA, 2675 bp, Homo sapiens
ccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtg

SEQ ID NO: 6673 - DNA, 627 bp, Homo sapiens
gagagcccggcaacacctcagcccgagcccggcgaggtctctgggctcctggagcgaggtgagcgccccaggccgcggtcctgcctacgccgggacagccatggcgactgggtcctgctccttcccggccggactgacgcggcctcccaggacccgagcacgtgcgtgatgggcgaggagggcctaggccgggcagaccagtgcagggagccgattcttctcggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaa

SEQ ID NO: 6674 - DNA, 2158 bp, Homo sapiens
tcagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcact

SEQ ID NO: 6675 - DNA, 2484 bp, Homo sapiens
agtgcgcgcccagagcctgcgcggaacccaccctggcccgctccccgcgccctccacgggtaacggccccctctctcggtgctcagaaaccggcggtgtcgacaggtggctctcgcttggcctccttgtctgcaagcctttctcctagagatctgtgcctcctggcgaaccatgggagacctgccgccctaccctgagcgccctgcccagcagcctccgggccggaggacttctcaggcctcccagaggcggcacagtcgggaccaagctcaggccctggcagcggaccccgaggagaggcagcagatacctccagacgcccagcgaaacgcccctggttggtcacagaggggcagcctgtcccaacaggagaacttgctgatgccccaggtcttccaggctgaggaagcccggctgggtggcatggagtacccatctgtgaacacgggctttccctcagagttccagcctcagccttactctgatgaaagcaggatgcaggtcgccgagctcaccaccagcctaatgctgcagcggctccagcagggccaaagcagcctgttccagcaactggaccccaccttccaggagcccccagtcaaccccttgggccagttcaacctctaccagacagaccagttctctgaaggtgcccagcacgggccttacataagggatgaccctgcccttcagttcttgccctctgagctgggcttcccacactacagtgcccaggtgcctgagcccgagcctctggagctggccgtgcagaacgccaaggcctacctgctgcagaccagcatcaattgcgacctcagcctgtacgagcacctggtgaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaaaaagtttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagagggcagggatagaaaaggaaggcaactgcttcaaataaaattcctccacggcatta

SEQ ID NO: 6676 - DNA, 8661 bp, Homo sapiens
gagttatttgacgccgccgcccctggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaat

SEQ ID NO: 6677 - DNA, 3149 bp, Homo sapiens
agtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcagctggagccagagttttatacttcacttttccaggaggttggactcaagaactgcagttcttag

SEQ ID NO: 6678 - DNA, 8639 bp, Homo sapiens
agtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaataa

SEQ ID NO: 6679 - DNA, 8435 bp, Homo sapiens
cttggcgccctgggagagtcgctgacgggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaat

SEQ ID NO: 6680 - DNA, 8652 bp, Homo sapiens
gagttatttgacgccgccgcccctggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaat

SEQ ID NO: 6681 - DNA, 4075 bp, Homo sapiens
attaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaa

SEQ ID NO: 6682 - DNA, 1727 bp, Homo sapiens
agttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgattttacatgcttttaattcaaggtttgcagataaatgattatgtgtgccatcctgtctt

SEQ ID NO: 6683 - DNA, 3278 bp, Homo sapiens
ccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattcta

SEQ ID NO: 6684 - DNA, 640 bp, Homo sapiens
accaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctca

SEQ ID NO: 6685 - DNA, 3278 bp, Homo sapiens; identical to SEQ ID NO: 6683

SEQ ID NO: 6686 - DNA, 3278 bp, Homo sapiens; identical to SEQ ID NO: 6683

SEQ ID NO: 6687 - DNA, 2956 bp, Homo sapiens
aaaacccggccgggatttcggtcagctacattcgtgggttgtggtagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtag

SEQ ID NO: 6688 - DNA, 640 bp, Homo sapiens; identical to SEQ ID NO: 6684

SEQ ID NO: 6689 - DNA, 640 bp, Homo sapiens; identical to SEQ ID NO: 6684

SEQ ID NO: 6690 - DNA, 1820 bp, Homo sapiens
agaccgacggcaacagcggctcaggacccacgctgcccccacccctcccgagcaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggtgagcggagtgtctgggctggatgctggacttccctatccatgttccaggaaggggagggggaaaagtcaggggtccctgagttttggctcctgcagtttgagggctccttcccaggagtttgcagtcctttctgagttgcgacggctccagaatgaatgtcgtggctataacctccaacctgaccatgatatccagaggtggctacaggggctccggccactgacagaggctcagaggtgactggcgggtgaggttgggactccagggttctggccaggtgtgggggattggtgtcatgtcctgagctctgcctattgcccccctaacccagccatcgtgtatcctgtgaggtggagccacctggttccagtgaccctcctgccccacgggtgcttcggccaacattggtcatctcgcagtggacagagtgagagattcactggctggggggtggtttcttgggacttccacttttctctgatcctcccaatctcctgccactgcagggttttgggctctgttggggtcccta

SEQ ID NO: 6691 - DNA, 640 bp, Homo sapiens; identical to SEQ ID NO: 6684

SEQ ID NO: 6692 - DNA, 3278 bp, Homo sapiens; identical to SEQ ID NO: 6683

SEQ ID NO: 6693 - DNA, 640 bp, Homo sapiens; identical to SEQ ID NO: 6684

SEQ ID NO: 6694 - DNA, 3278 bp, Homo sapiens; identical to SEQ ID NO: 6683

SEQ ID NO: 6695 - DNA, 1820 bp, Homo sapiens; identical to SEQ ID NO: 6690

SEQ ID NO: 6696 - DNA, 2956 bp, Homo sapiens
aaaacccggccgggatttcggtcagctacattcgtgggttgtggtagggagggtaatcccgtggggatggagtaaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtag

SEQ ID NO: 6697 - DNA, 2956 bp, Homo sapiens; identical to SEQ ID NO: 6687

SEQ ID NO: 6698 - DNA, 2956 bp, Homo sapiens; identical to SEQ ID NO: 6687

SEQ ID NO: 6699 - DNA, 2956 bp, Homo sapiens; identical to SEQ ID NO: 6687

SEQ ID NO: 6700 - DNA, 1820 bp, Homo sapiens; identical to SEQ ID NO: 6690

SEQ ID NO: 6701 - DNA, 1820 bp, Homo sapiens; identical to SEQ ID NO: 6690

SEQ ID NO: 6702 - DNA, 1820 bp, Homo sapiens; identical to SEQ ID NO: 6690

SEQ ID NO: 6703 - DNA, 1538 bp, Homo sapiens
gcgagagcaggaagaggagccgcctcaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccac

SEQ ID NO: 6704 - DNA, 2543 bp, Homo sapiens
acccgccacccgccggcccttccgcctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaacagg

SEQ ID NO: 6705 - DNA, 2561 bp, Homo sapiens
acccgccacccgccggcccttccgcctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagcctctgcatctcccccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaacagg

SEQ ID NO: 6706 - DNA, 1455 bp, Homo sapiens
actcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcagtgagtgattacagtttgggatggggacaagtgggaccttcagggagggttgtggatggtgatggggtcagtaatggccccaagtgactggagctttgggggctgcagaaaccacccccaggccctgtcccctaccttggcaccttccttacggacctggttatgctggacacagccctgccggatatgttggaggtctgacccctgacccttgacccctgaccccagctccacttgcccccagcacaatgggcctcccaatatccacccttgatcctacctgtactcctgacaccaccccacactcccttactacagtggggctcctgacatcccagcccctgaccttgacccttgacccttgaccctgggtgctgcaattcagacacactttgcccccagggggatctcattaactttga

SEQ ID NO: 6707 - DNA, 571 bp, Homo sapiens
aaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcagatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccc

SEQ ID NO: 6708 - DNA, 2701 bp, Homo sapiens
cgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 6709 - DNA, 1924 bp, Homo sapiens
acagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 6710 - DNA, 2168 bp, Homo sapiens
tgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcgatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttctttt

SEQ ID NO: 6711 - DNA, 595 bp, Homo sapiens
agatctagggaggagggaacagcagaggcaaaggcagcttgggagggatgggaaatggaaaatcagggaaacaaacaaacaaacaaacaaaatgaatgagtgaatgtgggcttgaatagtaaaacttccagagagaagacgatgggatctctccccaggtaactacctgtagatgaaaaatagatgaaatacacaaggaagtggcaagcaacaactttgagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttg

SEQ ID NO: 6712 - DNA, 1684 bp, Homo sapiens
agtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaac

SEQ ID NO: 6713 - DNA, 3852 bp, Homo sapiens
atgaagccgctggagaaatttctgaagaagcagacgtcgcagctggcgggccgaacggtggcgggaggtcccggcgggggtctggggagctgcggtgggcctggagggggtgggggacccggcgggggcggcggtccagccgggggacagcggtcgttgcagcggcgtcagagcgtgtctcgcctgctgctccccgctttcctccgggagccccccgccgagccggggctggagccgccccctgaggaaggaggagagccggcgggggtcgcggaggagccgggcagcggggggccctgctggctgcagctggaggaggtgccggggcccgggcctctcgggggaggggggcccctgcgctccccttcctcctactcatctgacgagctgtccccaggcgagcccttgacttcgccgccctgggcccctctgggcgcccccgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccacctctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaacctg

SEQ ID NO: 6714 - DNA, 3727 bp, Homo sapiens
gcggcggtccagccgggggacagcggtcgttgcagcggcgtcagagcgtgtctcgcctgctgctccccgctttcctccgggagccccccgccgagccggggctggagccgccccctgagaggaaggaggagagccggcgggggtcgcggaggagccgggcagcggggggccctgctggctgcagctggaggaggtgccggggcccgggcctctcgggggaggggggcccctgcgctccccttcctcctactcatctgacgagctgtccccaggcgagcccttgacttcgccgccctgggcccctctgggcgcccccgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccacctctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaacctg

SEQ ID NO: 6715 - DNA, 1734 bp, Homo sapiens
agaaggaagataaactccacatatttctgtgagtatgagaaaggtgcacactcttgggttcagcaatctgtaggcctgacttgggtacacagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagt

SEQ ID NO: 6716 - DNA, 540 bp, Homo sapiens
atatttctgtgagtatgagaaaggtgcacactcttgggttcagcaatctgtaggcctgacttgggtacacaggcgagcccttgacttcgccgccctgggcccctctgggcgcccccgagcggcccgagcatcttctgaaccgggttctggagcggcttgctggaggggctaccagggacagcgccgcctcaggcagaactcaaccttggtgtgttatctgaccaacttcccacatacgctgaagagaagtgcacatggccatcaaaggcacgcgccccccccttcccttcagctgccttggcagctgccgaacccaccctcgcagtggctgcccagaacctttacacatgtatgtgtgcgcgtgtgcagagcatgacaagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttctt

SEQ ID NO: 6717 - DNA, 779 bp, Homo sapiens
ctctgtgtttggaaatactctttgtctggagacacttctgtgggctacttcttttttcaggcagaactcaaccttggtgtgttatctgaccaacttcccacatacgctgaagagaagtgcacatggccatcaaaggcacgcgccccccccttcccttcagctgccttggcagctgccgaacccaccctcgcagtggctgcccagaacctttacacatgtatgtgtgcgcgtgtgcagagcatgacaaggcaggtggctggggctccagcctggctaaagagaacttgcccttaggggcaagagagggaggcactgcatttccagtttcgttctggaagtgcccacctgacatctgtggtgcccactgatctttacagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccggg

SEQ ID NO: 6718 - DNA, 560 bp, Homo sapiens
aatgctaattcacccaagaggccttcccagctcttctcacagaaggaagataaactccacatatttctaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagccc

SEQ ID NO: 6719 - DNA, 3021 bp, Homo sapiens
gcaggcctctcctccgagaacagaggccaggtcatgactcactggcttcctgcaacctgacgatggcccagccagaagacaaggcacctgaagtccccacagagggggtgaggtgaacaaagcagacaggacccctctaggggtcctcagcaccctagagccacttactcgcctgcagaggacatggggggtgtggcatgtgccagagctggatacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgcatgccagacctgccccatctcctggcctttctatcagccagcagggatgttctgcccagaaccctgctcttgccccctcccactctagggcccagagatgaacacacagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagccccgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctaccaaaaaaaaaaaaaaacaaaaattagccgggcgtggtggcgtactcctgtggtaccagctactcaggaggctttgcagttttagacaggcgtatcagagaaagcctcactgaggtgacatctgcagaaaggcctgaaggaggggaggggaagggaggagcagagtgggtattaggaagagcattccgagaagcaggatgagccagtgcaaaggcccagaggtaggctgttcccttttcctgggacccctccctcctccttgctgctcctaaaccacataggtcaggagtctggactgacccaggtacgtctggcatcttgcttgaggaacagggggttttgttttgttttgaaagaacgtctctgtctgttgcccaggctggagtgtagtggcatgatctcggctcactgcagccttaacctcctggctcaaacaagccccctgcctctgcctaccaagtagctgagactacaggcacctaccaccgtgcctgtctaatttttaaaattttttataaagatgaggtctctctttgttgcccaggctggtctcaaactcctaacctcaagcaatctgcccacgtcggcctcccaaagtgctgagattataggcgtgagccaccgtgcccaattgtgatcgtttttcccaaagaatgtatcacatgctaacaaaccatatatttatgtatttcattgttcatagtaactacaatttaaaaaactaaaaagaaacaagtgaggccgggtgcggttgctcatgcctgtaatcccagcactttgggaggccaaggtgggcagatcacctgaggtcgggagttcaagaccagcctgacaaacatggagaaacccgtctctactaaaaatacaaacttagccgggcatggtggcgcatgcctgtaatcccagctactccggaggctaaggcaggagaatggcttgaacccgggaggcgaagattgcggtgagcggagattgcgccattgcactccagcctgggcaacaagagtgaaacaccatctcaaaaataaataaataaataaaaagaaacaagtgaagttaacgttaataataatatatttgatttaacacaatgtatcccaaatattatcacttcaacatgtatccatattaaaaagttactgacatatttaaaa

SEQ ID NO: 6720 - DNA, 2414 bp, Homo sapiens
gcaggcctctcctccgagaacagaggccaggtcatgactcactggcttcctgcaacctgacgatggcccagccagaagacaaggcacctgaagtccccacagagggggtgaggtgaacaaagcagacaggacccctctaggggtcctcagcaccctagagccacttactcgcctgcagaggacatggggggtgtggcatgtgccagagctggatacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgcatgccagacctgccccatctcctggcctttctatcagccagcagggatgttctgcccagaaccctgctcttgccccctcccactctagggcccagagatgaacacacagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagccccgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggccaacctgccctttaaggagccatgggcagaagagactgtgacagggaccagtgacaactaggggtttcacacccctccgttcatgcctgtaatcccaacattttgggaggccaaggtgggaggctggtctcaaactcctaacctcaagcaatctgcccacgtcggcctcccaaagtgctgagattataggcgtgagccaccgtgcccaattgtgatcgtttttcccaaagaatgtatcacatgctaacaaaccatatatttatgtatttcattgttcatagtaactacaatttaaaaaactaaaaagaaacaagtgaggccgggtgcggttgctcatgcctgtaatcccagcactttgggaggccaaggtgggcagatcacctgaggtcgggagttcaagaccagcctgacaaacatggagaaacccgtctctactaaaaatacaaacttagccgggcatggtggcgcatgcctgtaatcccagctactccggaggctaaggcaggagaatggcttgaacccgggaggcgaagattgcggtgagcggagattgcgccattgcactccagcctgggcaacaagagtgaaacaccatctcaaaaataaataaataaataaaaagaaacaagtgaagttaacgttaataataatatatttgatttaacacaatgtatcccaaatattatcacttcaacatgtatccatattaaaaagttactgacatattt

SEQ ID NO: 6721 - DNA, 1994 bp, Homo sapiens
agtctgaacgatgaccaatccaccacacgcacctacagtgtaggtcttccattttactctctagtctggttctggggctgggcatagaactgttggagttgatataaagatcagggttacagctcctagagtggagtattttgggctgagacgatggggttttccagatattggatcatgtcatctgcaaagaaagacaacttgacttcctctcctcccatttgactacactttatttctttctcttgcctgattgccctggcctgaatttccaatactatgttgaattaatgactcaatatatgactaaaagttcaaagtgaaacaatgataattcagataggaaaatatgtggcagtatgctaaagtctaaaaaggaatataaaacgtctgtgagatacctaacatcagatttatagaaacagaatagaatctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacac

SEQ ID NO: 6722 - DNA, 2320 bp, Homo sapiens
ggggagtgcggcgcggggacgggcgctgggcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgagctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggggatcatcattctttctgataagcaggagtgtaaagattagatatcacaccaaaagctcaggcaagaaaagcaaaaatgaacaagtgggactacattaaacccaaaactcctgcacaacaaaggaaacgatcaccaaaatgaaaaggtggactgtagattgggagaaaatatttgcaaaccgttatctggtaagggtttaatatccaaactatataaggaactcacagaacttaaagaaaacaaataatccaattaaaaatggtcaaaggggctgggcatggtggctcacgcctgtaatctcagcactttgggaggccgaggtgggagaatcacaaggtcaggagactgagaccatcctggctaacaccatgatgggctaacacccatctctactaaaaatatgaaacattagccaggtgtggtggcacgcgcctgtaatcccagctactcgggaggctgaggcagaaggattgtttgaacccgggaggtggaggttgcagtgagccgagatcgcattactgcactccagcctgggtaacagagtgagactccatctcaaaaaaaaaaaaaatagatatttttccaaagaagacataaaaacagccaacaggtatatgaaaaagtgctcaacatcactgatcagcagggaaatgcaaatcaaagccacaatgagataccacctcacacctgttaggttacatctgctattgtcaaaaagataagagatagcaagtgtcagcaagggtctggagaaaagggaatttttgtatactgttggtgggaatgtaaatcagtacagctattgtggaaaacagtgtagaggtttctcaaaaaattaaaactatcatacaacccagca

SEQ ID NO: 6723 - DNA, 5290 bp, Homo sapiens
gcggccgcggagctccgggtgccgccgcgtccccagcgccccggccggcccctctgggcggcctgcgggggcggcgcagttgcgaaactgactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgttgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgttttttttaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcttgggcagatggacagttcccattgtgcattgcctttgataaatttggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttcgtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagcttt

SEQ ID NO: 6724 - DNA, 523 bp, Homo sapiens
gcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagac

SEQ ID NO: 6725 - DNA, 587 bp, Homo sapiens
agtctgaacgatgaccaatccaccacacgcacctacagtgtaggtcttccattttactctctagtctggttctggggctgggcatagaactgttggagttgatataaagatcagggttacagctcctagagtggagtattttgggctgagacgatggggttttccagatattggatcatgtcatctgcaaagaaagacaacttgacttcctctcctcccatttgactacactttatttctttctcttgcctgattgccctggcctgaatttccaatactatgttgaattaatgactcaatatatgactaaaagttcaaagtgaaacaatgataattcagataggaaaatatgtggcagtatgctaaagtctaaaaaggaatataaaacgtctgtgagatacctaacatcagatttatagaaacagaatagaatctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagcctt

SEQ ID NO: 6726 - DNA, 772 bp, Homo sapiens
agtctgaacgatgaccaatccaccacacgcacctacagtctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtc

SEQ ID NO: 6727 - DNA, 5505 bp, Homo sapiens
ccaggactgtaagaaccctatgtacctttgcaggtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgttgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgttttttttaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcttgggcagatggacagttcccattgtgcattgcctttgataaatttggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttcgtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggcatt

SEQ ID NO: 6728 - DNA, 330 bp, Homo sapiens
atggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccttagctaa

SEQ ID NO: 6729 - DNA, 853 bp, Homo sapiens
tcactatcagcgaaccagaaagcaggctctcacccgacgctgagtctgacggtgacttgaccttggactttccagcttccagaaaactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaat

SEQ ID NO: 6730 - DNA, 555 bp, Homo sapiens
aaaccatatttcactgggagagcaaactgctagcatttatcatcccctccagctttaagttacagaggctaaactcctgctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggag

SEQ ID NO: 6731 - DNA, 2219 bp, Homo sapiens
atgtgaggacacagcaagaaggtgccatccgtgaaccaaaaagtgagcccttgccagacacctgatccgctggtgccataatcatgaacttcccagtctccagaactgtgagaaatacaagtttctgttattggtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggcca

SEQ ID NO: 6732 - DNA, 577 bp, Homo sapiens
gaacgatgaccaatccaccacacgcacctacagtctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgca

SEQ ID NO: 6733 - DNA, 2931 bp, Homo sapiens
gcccagtccagcgcccgccgcccgccaccccggaccccggtgtctggcttcccccgagccggcaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtc

SEQ ID NO: 6734 - DNA, 2723 bp, Homo sapiens
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtcc

SEQ ID NO: 6735 - DNA, 6344 bp, Homo sapiens
gtgcgtgtgtccctgtccgcgctgctgaaacgggctcttcgagggatcggcgtcacatgactccgcctgcccctcgccagcgcgcagatcgccagtccctcagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataatt

SEQ ID NO: 6736 - DNA, 2850 bp, Homo sapiens
ggagccctttttggcctacttggggtgagtcaacataaggagtgcaggccaccttagcctttgcttctcaaaagtcatggggcaatgaaggacttggccaaggctgtccagcagtaggccaagttcagggattggctcaggcccctaatggacttcactgcatccaggaatggtaggtgattatcttttccgagaggccacctacccagatcccagttgtggacagcccatcccagccctcagaggctcagaggctctctgagtgccctgccccaaaacaccctaggcaagacattatgccagagcctcagctctagggctgcctggagcagagctcctgaatcacactggctccccagggctccccaggaacctcaccattcctcccccaatccacacctctgctgccagagcaacgcaacgacccagaatacacccgttccctcttctgttccctcctcctgcccccacctcaggcctcactggggcagggtacatcttgcctctctgccctgaacttctgaaacctcaatgatcagattcccagggctctgagaaaacagaagcaaacatcccatccaggatggatttaccccctaaaagtcactgagatcattcccaggggcccagcagacagtgtccttcctttcccagcagcagtgccctgcagaacaaagaggctggttcagagccagctctcagccctatggccttggctgagtcccttaacctttctgagactcagtttcctacctgtgacattcctgcagttatcctgtaggaataagagtgcctacgtcctggggcaacagtgagggttaaaagatcaatcctatcctgtgtgcaacgtggagcagacagcctcgatgagacaagctatggtttgcaatgttctggatgtataacctgtttccagcctggcctgaggtggaaccctgtcatgaggatggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtc

SEQ ID NO: 6737 - DNA, 6294 bp, Homo sapiens
cagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagaggaccagggaggggaccagggaagcagaaatgagcaggtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaa

SEQ ID NO: 6738 - DNA, 6246 bp, Homo sapiens
cggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaa

SEQ ID NO: 6739 - DNA, 3264 bp, Homo sapiens
ggtgcttgcttggctcgcgggcagaggagccgccgctcgctggacgccggaccgggcaggacggcgcggggagccggcggccagaatgttcctggagccccaggaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatattttaaaaaacccagccaaaaccaacgtgagccctgcctgctcggacgcctttccagccagtgtctctgacgtcggggttagtgccttagagggtactggggtctggtcttcctgctctgtggtttgggctgcggtgagtcccactccacctgggcgcctgccctcaggagcctgggctgcgaggctccataggagggctggtggctgggaggtcgcgtccgcacacttctggaagtgagcctttgagtacgggctgtccaaagtttacattttcattttcctttcagggatttgtggggtcagggaggggcagggggcacctggcagcatattttctgtgacaatgtgtccagcaaatcattcttcaactacattttagaaaggaggaaatctaaaataaggtaagggagggaagcatggagttgtcagttttctgggctgtgactgaaagacacactgagctgtgatgaagaaaaatacatggccgactccagggtggtgacatttagagctagtcttgaaacctatcatctacagaggggagggcagccaacagccctcttcccacctgggtaggcagcgccctaattggaattggaaacagaaaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacacccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactcccc

SEQ ID NO: 6740 - DNA, 4104 bp, Homo sapiens
tcatgatggctattgctgtgactggagccaagagcccagtgtgcaattcttccttgggaaggggctgcctggtggtggacacagctgttcagatacacaggtttgcagctgcctgtcgaagtgcctgcccctgctgttggggcaaggaggaagcaggtgcaagaacaagcgacctcagggctgggtgggggtggccggcaggggaccccgcagtggaagtgctgtcatcatcaccatttcacagctgggaaggtggagggctggccagatgcacccaggaacaaggagtgggcctgctgcagggccggcattcctgcccgggaaaagccatgtagggaacctgcctctccacttggcactgagccctggagaccctcctcgaagtgctccgtggctgggcagggtgggccctgctaggtttgagctttcgggggtaggggctcatggggcatcccccagacctgcagggtcttggtttgttggatgcaggagacctagccctgggccgtgtccccaggtgggtctccaggtaggcaggacagaaggaacccagagcaccccacctctcaggtcagtgcggctccacacggtccccctcaggctctgctgactccccaaagggattctgagcatgtgcagaacctctgcttgcctgggacacccctgcatgctcctcctccaggcccccaccctcgaaggcgtggccttcccagcccctctctggctgctgaccagtgggctgggtccccaggatggctcctcaactcctaggcaggcctcctagcactgaggcaggtctctctgcaggctggacatggagtggccttgccctgtgggggatcggctggggctgagtttgtggggtgtcagagtgcatcccccacatactacctcctgaccagagcagcctgcagtgggagaggccagtggctcggcaaatgccctctctgatgaccccaagagcttggggtgaggaggcccaactgaccaaggttaccacctgctggtcgccttttgaacccagaactgtgtgatcttggggaggttgtcccacagtgcattggcctcagatgcctgagacagtgctgagcagctgtgggcaacaaggggtttgtgagcccgccttcgtgacttcattgcacaaatggtcactgagtgccaccctgggccagcgataggatacacaggtgaatgatacagccacttctggctttgtgggtcaacagtctaggttaaacccagggaggcttcctggaggtggtgacacctaggctggacttggaactcctggggtttccttagttgagttccttcccactgggcctcagtttcaccatctgaaaaatgaaggattggctcacatcagtggttcctgggctggagtggagagcgcgttggggtacagaagcagtccaccccagagtttctgaccagcaggtctggggctaggcctgagaatgtgcattctaacttgtgtgaggcaccgctgctggcctgagtttgaagggagcattgtatgagtctgagccatgacctccctgtcctggagtgggggcagcactgagcctgggggcctggacattccacccagcgtcatcgtggggcctttggttgcgttcttgctctccttgccaaagactttctaagaattccaaggaaacctttaggtgtttggtgggaaaaccagtgacgtctgggccagatgctcttttttccctggtgggagggacagggacgtgctgtgtgtgtgtgtgtgtgtgtgtgtgtgtgtgtgtgtgtgtgtgtgtgtgtgttgacgtggggggtgtgggcaggtggtccgctctctccttgtaaggcccctacagggcagaggcccacggtcctgtcatggcactgaagtaatcatggcaacaatttgctctgtgcagtggggaaactaaggccaaaatggcaggagggtctcgcttctccacctgacctcagccgctggcacctgtgctgccttcccttgagggccaggaggttgaggctggctctgtgtgcaggcaaggccacaggcaggccacctctggccctcaggctggcagttgctgcatcgtccagtccccacttggctcctcccaggcatggctggctgtctggggcactggggaaacaggcccagagggcttcagactcccctaggcttcacaagaactcccagctgcagggtgtggtgagaccctgagccccatcacagcgggccatgctgtggaggacagtcccagtgtgggcaccgaggcctccaggaggcccagctgctcagacatctgcagctcaggggcactcagactcacaggccccaaagccagttccagatctctctctagccctgcccacagccctgcctcatactggtcagccacttggcccaagaccttcaccatgtggagtggccctgctcgccactcctgctaccgcctgcctgagcaagctctccttgggctgtggcaagacccaccatccacgtggcagccaccgaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatc

SEQ ID NO: 6741 - DNA, 3235 bp, Homo sapiens
ggcgccggccgcgcgctgctcggggcccgactgcggcgcgagggcggcgcgggagcgacgctggcccggaccgaggaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatattttaaaaaacccagccaaaaccaacgtgagccctgcctgctcggacgcctttccagccagtgtctctgacgtcggggttagtgccttagagggtactggggtctggtcttcctgctctgtggtttgggctgcggtgagtcccactccacctgggcgcctgccctcaggagcctgggctgcgaggctccataggagggctggtggctgggaggtcgcgtccgcacacttctggaagtgagcctttgagtacgggctgtccaaagtttacattttcattttcctttcagggatttgtggggtcagggaggggcagggggcacctggcagcatattttctgtgacaatgtgtccagcaaatcattcttcaactacattttagaaaggaggaaatctaaaataaggtaagggagggaagcatggagttgtcagttttctgggctgtgactgaaagacacactgagctgtgatgaagaaaaatacatggccgactccagggtggtgacatttagagctagtcttgaaacctatcatctacagaggggagggcagccaacagccctcttcccacctgggtaggcagcgccctaattggaattggaaacagaaaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacacccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactccc

SEQ ID NO: 6742 - DNA, 2277 bp, Homo sapiens
gtagtttcagtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactag

SEQ ID NO: 6743 - DNA, 1756 bp, Homo sapiens
ataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagataaccagatgagaaaaattgcacccaaaatccttcaactcctcacggaatggacggaaacatttccctatgattttcgggatgaaagaatgatgagaaacttaaaagatctggctcaccgaatagccagtggcgaagagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatgga

SEQ ID NO: 6744 - DNA, 3485 bp, Homo sapiens
cgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagcaggaccagagggctggtattctgtgttgagacttgctgggcaaggatgcccttgtagtttccatgttgcaggtcaacttctgggaacaagtcattcaggcacagatacactttcacctggaaaaagtagatgaagcatttggcaatgatgttgcattttattcgtcttaaaatgcattttccattatgaataaccttccttgagaactctttcagtggtgtgctgcaacgtataacttgataccctatcctttttttctgagacagagccttgctctgttcctcaggctagagtgtagagttgcgatcatggctcactgcatccttgacttctctggcttaatcaatcctcccacctcagcttccctagtagctgggactacaggtgcatgcaactgtgcctggctcgttttttctattttttgtagagacaaagcctcactatgttgcccaggctggtctccaacttttgggctcaagcaatccactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatccagagcatgtgacacaagtgcactgcagaccaagtcgatcagaatctctggggtggaacccaggctgcccccattcagcggttctgctcattgcttcccagcaggtacccttgtgtggtaccctgaatagaagtggtaatttcttactaaagtattttctgcagggatcccgggaaggggtgaggagaaggtgcatgatgtaggaatgataacatgcatggaatagcagctgaggcatagaataataaatatttttaaatgagttgttggcttttttaagtgaaaagaactttcttgtgcatgtctcatgcctgtgttatccaaaaaatcccattctgtgggaaaattttaaaacattttatttttaatatatcaagtaatataggaatatattcacttagattttgtttaaaaagaattcatacaaagcaaaagaggccaaaaaactccattcaatccagcttctctcttaaaggtaacaagtgttgtcaattttgtgtgtatccttccggcgctgctcctatgtatacaggtgttcacagaaagtagtgtgtatggcttttgtttccatgtatgtttacctagtattcatcaccctgcttgttttctctgtgttatgtcttggaaacccttccatgtcaatgtaggtagctgtatcttctttcagctgctatacagtagtccagtatgtgattgggccatgtttctttttctttttaaaaactattctattggacacaaacaagttaaatttgtttatactgaaaactcaggcgttttctgagaaagacttagcaaagaagattaagtcccttcttcatatcaaactctgtttagtaaagtagtaacatatagttgtgggttgctcttgtaaacaggctttactgactgtgaaacttcaactttgtaacatgtattttctactctgcacttgatcttagccaaaagggtgagaagcgattctaccctggatagtatatgctgtaattaagtatctccaagaaggtgtttattagccattctgagtaatacactgggaaatatttgcataattattagaagtagtatctaactctcatgtagtcatttgttatgacattttggacaaaggactgaataaaacattttaagttggt

SEQ ID NO: 6745 - DNA, 6323 bp, Homo sapiens
cgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagcaggaccagagggctggtattctgtgttgagacttgctgggcaaggatgcccttgtagtttccatgttgcaggtcaacttctgggaacaagtcattcaggcacagatacactttcacctggaaaaagtagatgaagcatttggcaatgatgttgcattttattcgtcttaaaatgcattttccattatgaataaccttccttgagaactctttcagtggtgtgctgcaacgtataacttgataccctatcctttttttctgagacagagccttgctctgttcctcaggctagagtgtagagttgcgatcatggctcactgcatccttgacttctctggcttaatcaatcctcccacctcagcttccctagtagctgggactacaggtgcatgcaactgtgcctggctcgttttttctattttttgtagagacaaagcctcactatgttgcccaggctggtctccaacttttgggctcaagcaatccactggccttggcctcccaaagtgctggaattacaggtgtgagtcactgcacccagccgcaattttttgtgagaaaaggggaagtatattaattgttgagggaattaagtgaaaaatttaaaaaccttcatctgaagaactttggggctatgttcatgtcagctcatgcacaggatttatgttgcaagtgtgttttaattttactttacttatacctttttacttccaaaaaggtttgacacagctagttagatgataataagtggcatcttaatagatataaacattttaatgccatttatcccaattttacaaaatcagactaaaattatgtaaggctagcttttgaaaaatttgtatgggctttcctgtattatgttctcatgaaaatgggattaaccattttactgttactttttgacattatattatgatgaacccaagtgctcgagacagccattatttctgccgggccgaatgagtcatttcctgagtcactgtgcaagttatgacggttataatcattttgccagtttgcctcttacaggttctagccaggtatgaattgataggtcccttgcttacaaaggcaaaagttaagcatcatggtgcagttttgtagtaaatcttatgttagaggggttagccgtggagttccttggcagggtcagtgctggctcagtgaccttggtttatgtatctgaagctgctcaaaagatcagtgacatcataagggctttttcttgtatgaaggctgagacctaagtcaaacagttttcatttcagtttggttgtctttagctacttaacattatatgtcagtcatcttatcttccctctattgcctttataacttagttctttccaaaagaaacaccttaaaaatctttttcttttaagataaaatgttggcattttgaaaataccaaatggatggtccttgttgttgcggcagtcaaaggggagatcatttttatttgtgtttacctgatgagaattggtctttttgtttaacagaatcaagccattcgagagctgggtagaacagagagaagggccaaacagccttgtgaccctggcttcttttcaacactcctgggttaataacatattcttgatagaaaccttgcgaagttcagatggttttgagcatgaaaagaggagataagaagacaagccagttctaactgaggaattgattaaactaagggttgagtggagagatgtcacctgccttgatcgggttgggtttcacagggagatgttgtttctttagctgcttctattcagtattcagaattcaaatccacacttgccagctggtttatctgagtgtgttttggctagtcctctaaatccttgctcctttctcatctctataaatcacagaagtaactgccttgtgttaatgccctttcagctctgaaactgtgtgatcgatgtccttcctccagttctttggcttcaggctccttatcagtcacgtgcttaggtggctctcctcagagagaccttcccttggcacccaactatgatcataccccctcccattatgggctttcactgctcttcccttcatagtcattcttagcactctgtgatgagtaatgatagctggccctctctctgtatttgtgggatctgcatccatgggttcaaccaacctcagattgaaaatattcaaaaaatattaagtctgtactgaacacatatagactttttttccttgtcattattccctaaacaatacagtatcacagtgatttacatagcatttacgttgcgttagctattataagtaatgtagagatgatttaaagtatacaggaggatgtgcggatgttgtatgaaaatactgtaccatcttagagcggagacttgaccatctgcagattttagaatcccagggaagtcctggaaccaatctcccgaggatactgagggatgactgtacttgcatttttattgcttgttttcccctctagaccccatgctgtgccctctttgttcaccacggcatccttaactcctagctcagtacctggcacctagtattctctcagtagtgtttgaatgaatgagtcaatcaatgaatgaatgaacaaatgaattactggaatagggaaaaattatttccctctattggaaggaatatgggtctgggttgggatttgttgcttcttgcctgggacttttttttttttttttctccttttggcagtcagtgaatccaggtgtgccgtatatataatttagtcaggttcttctgaatctaccaggacagttctacataatttggcataatatgtttctcccctggggatttgcccaaaatgaagtggtttattaggacttgcctgcaagaaacatgaaatgaaactaatgattgaattacatgacaaatgactgtagtgagtagaatgcaattttctcttccttaaggggctggtctttataataagagcttctatctttatttgccaggtaattactgtcactggcatttgaagttataaaaaagaataagtacatatttagtaattcatgactcagtgaggaaccatgcttaacaacacaaagcttgatttctcaaatggaatcaactggcagcaggaaacttttaaaagaggtcatatacatacactctctcacatgctcacacactagttgttgttgaatagctttcccccatactctattgcatacatttttcccttatattttgatgcagttttttgctaacaacctgattatacattcctctgcctcttcccccagtaaatttttctaaaattgcggaataggctgggtgcggtggctcatgcctgtaatcccagcactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatccagagcatgtgacacaagtgcactgcagaccaagtcgatcagaatctctggggtggaacccaggctgcccccattcagcggttctgctcattgcttcccagcaggtacccttgtgtggtaccctgaatagaagtggtaatttcttactaaagtattttctgcagggatcccgggaaggggtgaggagaaggtgcatgatgtaggaatgataacatgcatggaatagcagctgaggcatagaataataaatatttttaaatgagttgttggcttttttaagtgaaaagaactttcttgtgcatgtctcatgcctgtgttatccaaaaaatcccattctgtgggaaaattttaaaacattttatttttaatatatcaagtaatataggaatatattcacttagattttgtttaaaaagaattcatacaaagcaaaagaggccaaaaaactccattcaatccagcttctctcttaaaggtaacaagtgttgtcaattttgtgtgtatccttccggcgctgctcctatgtatacaggtgttcacagaaagtagtgtgtatggcttttgtttccatgtatgtttacctagtattcatcaccctgcttgttttctctgtgttatgtcttggaaacccttccatgtcaatgtaggtagctgtatcttctttcagctgctatacagtagtccagtatgtgattgggccatgtttctttttctttttaaaaactattctattggacacaaacaagttaaatttgtttatactgaaaactcaggcgttttctgagaaagacttagcaaagaagattaagtcccttcttcatatcaaactctgtttagtaaagtagtaacatatagttgtgggttgctcttgtaaacaggctttactgactgtgaaacttcaactttgtaacatgtattttctactctgcacttgatcttagccaaaagggtgagaagcgattctaccctggatagtatatgctgtaattaagtatctccaagaaggtgtttattagccattctgagtaatacactgggaaatatttgcataattattagaagtagtatctaactctcatgtagtcatttgttatgacattttggacaaaggactgaataaaacattttaagttggta

SEQ ID NO: 6746 - DNA, 3016 bp, Homo sapiens
gtttatttttgttgtcagtgccatgtaatctaaagtctgactcgtaggaagggacaagggaacagaagtcacatactcgccaccgacaaggtgatgtgctgtcatccttcggtgttcacctggcaaacttgggagacactgagtcgccttgcttttgccagagctcagttgagtcgcctcgggtcacctgcctggggaatctcagatgagctagaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactagaaagaaaataaaaagcagagtttgtcattggactgcttaacatgctagaaggactttttttttttttttttttttttttttttgctcttctgagctgtttacaactgaccactgtgttccacagatgtatttttcaatagctttttgttacttagttttccatgatgcctgttatttttctcttgtaaatttaaatgagctgactttaaggatcttgggaaaacccatggcataattacaattttctttttaatcgacttttcattacttttgggagtctgttggtaactaaagatgtcaacaaagaataaattggagaagttacctgtccccactatagcagtaaacaaaacagatgaaaaacaccttgctgttaactcaatggttgatctaattgtgaaatcgttcaccttgttaaacatctaagtaagtctgtagtcgctctgcaaacagccattatatttatttactctagaagaaactgtagagtagtaattcgtgctaatgagaaaaacaaaataccatgttcaaaacagatgtatttgaaaacttaatgacatggttccaaaaactagagcatgtatgtatgctgtgcatcatctcagcagacctaaaatatccccaagttgtccctttacagccatcaatatattttacactctgcggccagga

SEQ ID NO: 6747 - DNA, 2239 bp, Homo sapiens
cgggcggcggcggcggcggcggcggcggcggcggcggcggcgggcggcgccccggtccgcggcgccgaggctcgcaccgggagctgcccatgggccgggcccggagttccggcgcgccgggagccggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagcacctggtgcccacagccgactactaccccgagaaagcctacatcttcaccttcctgctgagctctcgcctcttcatcgagccccgggagctcctggcccgggtctgccacctgtgcatcgagcagcagcagctggacaagccggtgctggacaaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaacacacccgtacgccta

SEQ ID NO: 6748 - DNA, 2395 bp, Homo sapiens
ggggggaagaatctagaagaggcctgcccctgagtggggcaagaggagtagacaagagatgggtcctgcaggagagttgagaggccatgagaagacggagaatgaaggctgtgctgtgaggaaggggccctgacaatactcccaggaagtgaccactggactcaagctggcacaaagtggctgtggggggagcctgcccagccaggagccccgggaccagcagctcccactcaggtgcacccaactcaggtgtgcccccactcaggtcctcactgctccttgccattgcaggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagcacctggtgcccacagccgactactaccccgagaaagcctacatcttcaccttcctgctgagctctcgcctcttcatcgagccccgggagctcctggcccgggtctgccacctgtgcatcgagcagcagcagctggacaagccggtgctggacaaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaacacaccc

SEQ ID NO: 6749 - DNA, 2636 bp, Homo sapiens
gctccaggagccggctgagcgcgccccgcggggggctccgcagcccttacaaggaatttggtggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagccgtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataac

SEQ ID NO: 6750 - DNA, 1523 bp, Homo sapiens
ccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagcccca

SEQ ID NO: 6751 - DNA, 982 bp, Homo sapiens
tggctcatgtgatgtggtggcccgcaggctgtatggctgcaggcccggagggcatctggagacctgtgtgatcactcatatccttagaagaaatggtaataatgggtccagaattggtgggttcttggtctgacttcaagaatgaagccgcggaccctcgagccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagca

SEQ ID NO: 6752 - DNA, 2683 bp, Homo sapiens
ggaaggtaaaagctgcttcctgttggggcatgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaacca

SEQ ID NO: 6753 - DNA, 1556 bp, Homo sapiens
ttagctccttgggagcagacagctgtcctcactggcagaggaggagcgctcagtaaatgctcgctggacgaataaatggctagataagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgt

SEQ ID NO: 6754 - DNA, 822 bp, Homo sapiens
tccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgag

SEQ ID NO: 6755 - DNA, 3135 bp, Homo sapiens
ttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaatttggga

SEQ ID NO: 6756 - DNA, 1275 bp, Homo sapiens
ccgcagagtcggcacctgaaggacatggaggaaagaccggcagagaccaatgccaatgtggacaactcggcgtccccctcggtggcccagctggccgggcggtttagggagcaggcggctgcagccaaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagcca

SEQ ID NO: 6757 - DNA, 2565 bp, Homo sapiens
gccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcatggggaacagcaaaagtggggccctgtccaaggagatcctggaggagctgcagctgaacaccaagttctcggaggaggagctgtgctcctggtaccagtccttcctgaaggactgtcccaccggccgcatcacccagcagcagttccagagcatctacgccaagttcttccccgacaccgaccccaaggcctacgcccagcatgtgttccgcagcttcgattccaacctcgacggcaccctggacttcaaggagtacgtcatcgccctgcacatgaccaccgcgggcaagaccaaccagaagctggagtgggccttctccctctacgacgtggacggtaacgggaccatcagcaagaatgaagtgctggagatcgtcatggctattttcaaaatgatcactcccgaggacgtgaagctccttccagacgatgaaaacacgccggaaaagcgagccgagaagatctggaagtactttggaaagaatgatgatgataaacttacagagaaagaattcattgaggggacactggccaataaggaaattctgcgactgatccagtttgagcctcaaaaagtgaaggaaaagatgaagaacgcctgatgccaactgttcagctgtcctccctccacctaccactcacatgacacccgtgagcgcctgtgcacacacacacacatgcacacacacgcgcgcgcacacacacacacacacatccaccccagggccaagagaaaggcctgcacacaagcccacagcacagctccctgccaaactgaagcatctgtagtgacccactggttccttcttcctgggtcttcagcattccctcccatcatgcccggtcccacccctccctctgtccaccagcccatggccctgtgctaatcccaggattaggccataggagtcctaagtgtcaccccgctgtaagctcctttgtggagtgctgggtaagcagtttccaataaacgcaagctgagctgggcacgtggctgctggtcatccttcaactggaaaaggaaatgatttctatcagtcacacctcaaagacaaggctgtgttgcgatggcagccctaggctgggctgctttggtgcggaatgagtctaatgcggtcctgctgtcatggagctcatggtccagaggggacaatgaacctggaaggagccatgaccagtggcccaggttaccatggaaacgtgcagagcaccaggggaggacacagtggaaggggctgacttgtcaggggggatcagggaccacatccctgacgaagggagatttaaattcagaaccactgcacacgaggcgggggacggggtcggggtggggaagtctcaaacagaaggcggccaacacagagccgctgaggcatgaatgaccatctcgagttccaggagaaggtcggggtggctggagggtagaaggaggagggagagcaaagtgtgagctgaatctaaaaggtaggcgggggctggaccacgcaaagccctccctgcagcctgtggtaagcacttgggggctcaccatggggacagcggtgccactgtggagttggaagtaggaggggtttatgtttgtaagagaagtccccagcaggctaaaataagtcagagaggagcaactgggggctccctggagtcagggagcccgatgaataagcttttgcagccactcagatggcctgggccaggggaaaggcaatgggatggagaggaccagatccagtgaggacacatttaggaggtagcatccacctggctggctgagggggcaggaggagagagggcaggaatggcagccaggcctgtagcttgggcagtgggtgaatagcaatgccatctatggagatgagaaatacagagagtctttggggtttcagggaacaatgatgaattcagcttcaatatagtatgaggtgaaggcagagccatagatggccctaaagccccttgttttagagacaaggaaaaggagtcccaatgacaggaagcagcttgcccaagggcagccagctgatgagcagaggtcaggcaagggctacccaccggcccccaactgcctcctcaaagctccagggcctgggatacccaggaactccatcagtgcattctccaagatccctggatttgttgctttgaaggcccatttattctccagcctcaagttccaagatgaggtcagaaaaatgcatggataccctggattcttgactgacctgtctgcaacctcttgaggctgaggagtctctagttgctggtattgtggtgatgcctccagaccccactttagccacagagatgacacaatcaccactgccaaagagcactcctctgtgtggagagcaaacgtgagaataaacacttatgaaccgtg

SEQ ID NO: 6758 - DNA, 1022 bp, Homo sapiens
ttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaaatattggacatgggcgtatcttctaacgatgtcgtcaccattagtatattcttcctgctaaaaataaatatcaaaccctga

SEQ ID NO: 6759 - DNA, 1590 bp, Homo sapiens
atgagaaattccaattggagattttgtcaaacaggaatttactccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttcttt

SEQ ID NO: 6760 - DNA, 1850 bp, Homo sapiens
ttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttcttt

SEQ ID NO: 6761 - DNA, 4438 bp, Homo sapiens
actgccggccggacgccatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaatgtg

SEQ ID NO: 6762 - DNA, 3874 bp, Homo sapiens
aggctcgagcggtcaaagctctttccgggggcccggggaactactctccttgcctcgctctgtctccttcgaagtgctctgcgcgaggttcagagcggccgccgcctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaca

SEQ ID NO: 6763 - DNA, 1043 bp, Homo sapiens
cgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaagtgtctttttctctcctaaaagaaaatttttgagtcagtctttacaattacataattttatagatctggtcatgttgtataatagtgaaaaattaagttttgaatctagccctatttgtttaaagttaaatatttatgaaaaatctagatctgtttgaattaaaatgtaagtagaattggttttagggatggggtcggattttgttttttagtgactacaaaagtcaagcatgttaagtggtaatagccatctggttattttcctgcatttgcgttgagtgtttcaaatggttcattgtttgtgttaataaatactgccctgtgcccttactgttggagaatttttgcacagggtgtcagttcttactaagctgtttggtagtaagcatatatcagcagtctttagactgtcttttgatttagatttacagtaagtggtgtactgttttgttaaaaggaattatgtattatatgcatgtaattaagttattgaacagaagtttgtgataatctgctaccatgaccgtcattttactagaaatttgctttaaaaatggcatcttctaagaagctgttaaattcttcattttaatttg

SEQ ID NO: 6764 - DNA, 4612 bp, Homo sapiens
gaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaccactttcaaaactcagaagcagctgaaagaaaatctgaacaaacaaccgaataagcagtggaagaaatcacaaacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtatt

SEQ ID NO: 6765 - DNA, 7605 bp, Homo sapiens
ccgctcccgccgccgccgccgccgccgccgccagaggagcagcagcgcttgtgcaaaccgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaagtaaagaaacacaaccaaagccatttcatttggctggggggttggggagtggggaggaaaacaatctttattttaccccatctattgaagagtattattacatttgaaataaaacttccatcagtacagataaccacatgtgcaatgttgggatgttattttgggcttggcttatcgagtagtcaatggaaggattcccgtcccctctctcggcagcttagtaactgctgtagccagctcggctcccttccctgtgtatctgtgtcctgctaacagccaagagatgttgcaagggaggaaatgtgagagaccttgaacctgtcaggtttatttgttttgtttttaaaggcatgttgaagtttagttctttacccttctcctaaaatctttttttaatcagcctcaaggttaaaataaggagtgactacagtatgtaaaataaggaaaggaagcattaatggtgtgatgtgacctgcctgtttttttgtaaacaagagaataggaaatgttttcaaggtagtttcacatgtcttgcaccaagctcatgcctcttgcttttcctttttgactttatctccctcagtttttcttctgctgtggccagaaagacagtcactacagttgactattgatacaaaggtgcaacagaaatattatccctgcatttttaaatataagaagtagacattaattttaccatggtgcctccctaatgtaagtgatatttattggtggttttcaacaaaggttaactattaaagaaagaaatatttgtctttatcttccttttccccttgcctcagtcgtgttattcacccctattcttgatattttaaaggaggagattcagtagcattttcctttatattatacacatgtgtctatcccatttcaaggctcaagtcttacccccacctctcgctcccaataggaaataaagaccatttctgcccttagttgttttacatgcaagataagtgctttccttctccctggactgaaagacttgtttgtatttctacatctagtacttgggaaatagacaatcactgtactttgagtgtttatatctttatatctagggacactgaaaagtaaatgttgctttactacaatttttttttaatttagtgtcttaccccaaggcatactcaactgataatctccagctagatgagtaaaacagtatgtgtttagttttccagagaattctggcaagtttcatattttcttccaagttagtatagaactaactataggaagtatggggttgctttttcctccagtagaatattaaagatgggggagggtgggcaatgtagtgacagaaaatgattctctcagaatgaacttttcagagaaagagcagcataaaccaggtgcacatcatgatttgggagtttttgcgtaatttattctgttatttatttgggctcgccatgtgttctggggttaggatgctgcaggtcattcatcttcttaatgcctgtctggtcttaagccaactgttctttctttcctcgaccctctctgccctgtagctctccccacaaaaatgcatgataccatgaccttacgtgtgggatggggtatgtagtgtagcaaagaaaagaaagtatagttatattgagtcctaagacatttgttagggaaaagcataagagaaaatggggtgggaggtggggaaatgatatttgactttcaaaattgaaataggttttttttttgcagaaattaaatgggatgtttttcattctagaataaaagaatgtgaattctctttgctgctcttgtttaagctaaaagtagtgtttacttgataaggctctctgaccatttaatttttatcagaaaatgtggggatgtcaggaaagtggcttcctgaacgttggggcgggataattgtcctcaaaagtatgatggttaatacatgaaaggaagactttgttggacagtttcgaaggtgggcttttaaggagttgggtttttgtggggtacttttttgttttttaagccacaaaatcctcaatatgtttgttttaggatggaagtgaggatttgtatgagactgtcagctattaattttaaggaaatcttaaaatttacatttacatcagtaaatgaagatgacagtgtgtatatatgtgataaatagtgaaacagaaaagacagttctggtattcataacgtgaaagaaaggggttttattctttctgtgtctgtgatttaaaactccgtgaccatgctctgacttttgtatttcaacctgagtttaaacaaataaacaagatattttttaaagaaagcataacatagtgtgtcttagcaaggacatgattcatatggaagcagaatgtgagaagttgtaaggtccttggtactcactgtaaaatcacagacagagaattggtaggggttgtgaatacactagtaccacttaaagttcagtgatacagttcagaaatagggtccttaagtattttgaaagagtttactcttcagtcagcttagatgagagctctctccctgctcccctctaccctctcaaaagttgagagtaaatagaatttggtttgattccagggaggggaaaataagcagagaataggacttttatactttccaataccaggaataaaatgtttgtgatatatatgggtccagcaaacctatcgagataatgtgaatacgataaacttcctaatggcaggatattcactctcaatcctgaagttaccggttcctgcagaattgagcttcagctgttactgttttgaagccgctgtaaattactgctttccccagttcccccactattttttttaagtgggcgggggcgcctgttaagatctaaaatagatatgttggattgatattctcacgtgttcggtgtggaaaacaaaacaagtacatgctttagaagcaacaacaatgaaatccttttgaaatgtgtgttaatatcgtttaataaaataactagtttgaaa

SEQ ID NO: 6766 - DNA, 2899 bp, Homo sapiens
agcgcttgtgcaaaccgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgaaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaa

SEQ ID NO: 6767 - DNA, 3696 bp, Homo sapiens
gtcaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaatcaagcgagacccccagcagagataaatcatctcttagaggcctcctaacactgacagaaacttttctggtcaaaaatgaaaggtcctggtaccatcttccccagaaacgatcaagaagggcaatgggttgacagcccagatatggcaggaccagactgcaatgggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctg

SEQ ID NO: 6768 - DNA, 1772 bp, Homo sapiens
atcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccaatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggggctctgagatagggagacaacagaaaaagacaaacagcgatggagatgaaaactgttgatttgtgaggggcctccacagagaaaaacagggaaggtaacaagaaatgcatgcatctacagcaagaaagatggatgctacagagagagagggggacttcctggtgatgagaggaggtggaaattatgctcagtgtcaggagggtgagtgaagacatctgcagcagaatttatgagagtgcacaaagaattgattctataaccttcctgccctcaagtggcttccacctcaagtggaagattcagactcggattgctaacgaaaagtacctaaggacccacaaagaagtagagtggctcataagtggtttcttcagagaaatatttttgaaaagaccagacaacatcctagaatttgctgcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttcctgctc

SEQ ID NO: 6769 - DNA, 6301 bp, Homo sapiens
cgcgtgtgggcgcccgtcgcgttcctccgcccgttctcgccgggtcgcaccccccaccccgagggtgtacttggtacggcccgcgccgcctcctttcctcgcccgggtggccatccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggagccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggtggggcccgggccgaacggctgcggacacctgggcgccgaggagccgagcgccgccgcctccggcatggatcagtgcgtgacggtggagcgcgagctggagaaggtgctgcacaagttctcaggctacgggcagctgtgcgagcgcggcctggaggagctcatcgactacaccggcggcctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaggtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagcgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttctttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcatcgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaaccgtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgctttgttaatgtgtgtattcctatgtaaaacacatggcttttcctgtgtatatttttaaaaattaaagaaatgcacatttaaaaagtg

SEQ ID NO: 6770 - DNA, 1929 bp, Homo sapiens
gcggcttccggttccgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatt

SEQ ID NO: 6771 - DNA, 653 bp, Homo sapiens
gacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggatggagtgcaatggcgtggtcttggctcactgcaacctccacctcctaggttcaagcgattgtcctgcctcagcctcctgagtagctgggattacaggtgcccgccaccacgcctcggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaa

SEQ ID NO: 6772 - DNA, 808 bp, Homo sapiens
cggaagccggggccggggctgcggggcgaggtgagagcgggcgggcttgggagccggcaggtgcgggccgagggcgggcacagcggccggcggagctgaggcgcgcggcggggaaagctcggccggcctcccgggccccagccttctccagaacccctgctacccacgactaagccccgaacaatctgcccttgggcttgttctcttcgcagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtg

SEQ ID NO: 6773 - DNA, 562 bp, Homo sapiens
ggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagtggcctgtgaagctggtcctgggagtacctgtgatgtgaagtacgtagagaaggactctgaggccagagccagactgtctggcttcagttcagttcccagctcctccacttcccagacgcctgaccttgggcaactgatttaatctttgtgtctcattttctcatctgcaaagtgggtctaatcattgtacctacctcatagtgttttcgtgagcattaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccct

SEQ ID NO: 6774 - DNA, 4066 bp, Homo sapiens
gcggcttccggttccgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagggtctcactcttgctcaggctggaatgcagtggcataatcatggctgactgcagccttgacctcccgggctcaagcagtcctccgtcccacctcagccttctgaggagctgggaccacaggcgtgtgccaccatgcccaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaactccataggagaaatccgtgtaatgggattcaggaaaatgaagtaacttgcacaacagggctcacagcttagaaaggagagagcttggagttttaaccagatctgaccctcaagcccaagctatttccagtttattccagggtgcctgaacttggctgttatgtatactgagtcctgtgcagggcctctgacagcaggaaggggccccaagtctaaaatacttgaagggattgggttactagggccattatgttaagcaagagagctcgggggaatgcattttagcttcatattcctatttaaaatgtgctgtgtgggtgggtaaattgcttccataagcttcacagtggcatttaaggctcctgggttaagttaggaatgggggtgttcctgatgtgggggctttaggcttccatgaagtgggtctgggccccctgccttacctcacagcccccatctaccctggaagagggagttgaaaatgctgggatagcagcaggatcagttctcagcttgagccaaagcacccggccctgggcagctgagcatcagcacagaaccctctgagtcctttgggctctctgctgaggaagactgcttcactcttcccgcccaccaactcgctggcccaaccagcagctgctgcttaagaaaacacccacagactcaccacattttagtcttagcatttactttccccaccccacattcttggaacagcctttagttctacaggaaatggcactgatggacagaagactagcattaccttcatgaaagggctgttagagctgcctgggaagaaggcgtgccttggggaactgggaagatgccgtcagtgtgggtgggcaggaggacagccagtcgtcctgctgccagcccaatagcttccagcggcaggtgcccaggtgctaccggagcccctcataggggtaggggcagggactgcacctcctccaggcactcatcgtaagcctcctggtactcctcatggggcttgaccattatcacacaggtggggcgcttggagcctgcggctgcacccaggtcctacagaggggaaagaagtgctgtttggaaaaaagctgtacaacctgtatgccaggaagtcaccaactgatgacccaccagcctaatctggcccacaaccatgttctgttcggtccatgttctatttaaaagcatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgttacgtaagataaggacagctacaggtccctctgagcctaaacccacctaaccggactaacatgggtgaagcatcttagcttacaaagctctttcacatacatctatctctttattctcatagtccacagataactgactatttggttcttaccatcaggccaaacggtaagttccttcagaacagggcctcctgctttatcccaagaagtgatactgtaggtacccaagatccacccccagcctctattttttttttttgagacagggcctcactctgtcatgcagtctggagtgtggtggtgtatgatcatggctcactgcagccttgaactcctgggttcaagtgatctcctgctttagcctcccaagtggctgggactacaggcatgtgccaccacacccagctaattaaaaaaattttttttgt

SEQ ID NO: 6775 - DNA, 1884 bp, Homo sapiens
gatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagggtctcactcttgctcaggctggaatgcagtggcataatcatggctgactgcagccttgacctcccgggctcaagcagtcctccgtcccacctcagccttctgaggagctgggaccacaggcgtgtgccaccatgcccagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgt

SEQ ID NO: 6776 - DNA, 1147 bp, Homo sapiens
acagggcagtgtagttccagaaaataggactgaccaagaagcagaaaagcaagatgaatgatgtgaagcttgctgtcttgggtggtgaaggaacaggcaaatctggtccctacatccttaaataactgcaaatacttggtagtgtctttgtgactattacacatagtaccttgaagccagactgagtttgacagagaaaataaacagatgtcaaacttcttgcatctcaaatataatgagaaatctgtttctgttacaaaagcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 6777 - DNA, 1035 bp, Homo sapiens
atgaaatcagaatctgattggattaaaaaggagggaaagggtgtggctaaggtgggtggagacaccctctggtataaaagcccctggcaggcagctctcactccagatctgagctgtccgcagaagcagctggaggccaggggagaaactccagaaggagagacatttgccatggctgagcacttcaaacagatcattagatgtcctgtctgtctaaaagatcttgaagaagccgtgcaactgaaatgtggatatgcctgctgcctccagtgcctcaattcactccagaaggagcccgatggggaaggtttactgtgccgtttctgctctgtggtctctcagaaggatgacatcaagcccaagtacaagctgagggcgctggtttccatcatcaaggaactagagcccaagctgaaatctgttctaacaatgaacccaaggatgaggaagtttcaagtggatatgacgttcgatgtggacacagccaacaactatctcatcatttctgaagacctgaggagtttccgaagtggggatttgagccagaataggaaggagcaagctgagaggttcgacactgccctgtgcgtcctgggcacccctcgcttcacttccggccgccattactgggaggtggacgtgggcaccagccaagtgtgggatgtgggcgtgtgcaaggaatctgtgaaccgacaggggaagattgtgctttcttcagaacacggcttcttgactgtgggttgcagagaaggaaaggtctttgctgccagcactgtgcctatgactcctctctgggtgagtccccagttgcacagagtggggattttcctggatgtaggtatgaggtccattgccttttacaatgttagtgatgggtgccatatctacacattcatcgagattcctgtttgcgagccctggcgtccattttttgctcataaacgtggaagtcaagatgatcagagcatcctgagtatctgttctgtgatcaatccatccgctgccagtgccccagtttcttctgagggaaagtaa

SEQ ID NO: 6778 - DNA, 1900 bp, Homo sapiens
gagaggagcagaggtctgtagaggtagagacgtaggcttcggatcttttagaattctgctggaagtctccaagtcaagaggatctacaaagaaatactgagtggagactatactgagattctgttaaagacccacttgaattcagcccccattaggagaaactttggccggagcagccaacacatcacctggaagtcttcagactagactattgaagagtggattgtgtactgagggctcccaagtgcttccagaagccaataaaggatcacttcagtttacttcacggctaaggagtaacccttaagaaccatggccaaacgcctgcaagcagagttgtcctgtccagtttgcctggattttttctcctgttccatttctctctcttgtacacacgtgttctgctttgattgcatccagaggtatatactagaaaaccatgattttagagcgatgtgccccttgtgtcgagacgtggtgaaggtacctgctttggaagaatggcaagtgagcgtcctaacacttatgaccaagcagcacaatagccgacttgagcaaagtctgcacgtgagggaggagctccggcattttcgggaggatgtgaccctggatgcagccactgccagctccctccttgtcttctccaatgatctaagaagcgctcagtgtaagaagatccaccacgatctgacaaaagatcccaggctggcctgtgtcctgggtactccctgcttctcctccggccaacattactgggaggttgaagtgggagaggtgaagtcatggtccctgggcgtctgcaaggagccggctgacagaaagagcaatgatttattccctgagcatggcttctggatcagcatgaaggcaggagcaatccatgctaacacccacctggagagaattcctgcaagccctcgccttcgccgtgtgggaattttcctggatgctgacttagaagaaatccagttttttgatgttgacaataatgtcctcatctatacacatgatggtttcttctctttggagcttttgtgtccattcttctgtcttgagctcttgggagaaggggagagtggcaacgtcctgaccatctgcccatgagaaagtcagcccttcctagaagctttctgagaggtgaaagagaattttggcctgagaaaggtcagcatgattgaggaagagataatgtgctatagtgcaaagacttggtaaatttttaaagtagattttgtagactttgtagcaaaacaattttcggatttttggggtaaattttgtggaatttgtagctaggtaactggggtctttagggatgttattaagtactgtaagcttcagttttctagtctgtagatgcggataattgtatctcagtcaaacagctgtggtaattagagacaatactatgcctttgtcttatagtaaataacaaatagagaaatcttagattgtaagtaagctagatattaggttttgtggatagacaatatctttttcattatttcaagctgttttgtgtaattcctgataatgtctgaggaggaagaaaaattcaacagccagtgtgagttattttgttgatacagcatgaaatttcagagagacaaactgatattggggaagaactaagtttttcatttttattttctttgaaacacagccacataagttttcttgaaagacaaagaactttgaccaaaatgcattgttaatggtgattcatattcttatgggaagtgtcatttacccatctcaataattggactattgtgatttataagaattcttatcaaccatgttaactaacacatattcatcaaaaattgttttcaaggttgcttttggattttttatttgtagaatttattttcttgcaaataaatttataaagcattgg

SEQ ID NO: 6779 - DNA, 1201 bp, Homo sapiens
attaatgagcattctctccaaatgaagacatcacagcctcattcctaacacagaaagttatttatttcaaatacagtttcggtgggtaaataaggtggcgcattccttctacagaggacacacctaggagagcaagatacgtcccagtgaaacacagcttcgtcaccaacttcagtcaactctttggcaacatcacatcagcccatcaacttaacaggctaaaaatgccactttttggctggatgaaatggcccaaaaacgattcctacaaacccacacactatcctggctcagacatagtgacaaagactctgcttcgggaattaaaatggcacctaaaggagcgagagagattaatacaagaaatcgaaaatgaacaaaaagtgaaaaaaacaggtgtggattacaactggctcagaaactaccagaatccccacacaactatcccagtgactgaacaaagacaacttgaagttctttgctcacaagttcaaccttgccaaactggaactattctcagcagatttcgagaagttttggcagaaaatgatgtactgccatgggaaatagtctacatcttcaagcaagttctgaaagacttcctaagcagctctgacagagggagtgagcaagaggacctggaggactcagggagcatggactgctctgctccttctgtgatccaaggtgacagctccaagagggcagacaaagatgaaatacccaccatttccagttacgtagacaaaaacacaaaggacaggttcccagtgttctcacacagaatatggaacctaccatattatcacccatctagttaagttacttacaactagaggggtttttatgaacaccttagaactcctaatattaagaataagaaaaagtgatgtgacttcaagtttttctttgttacaaggtcagtatcctgtggatgtagcctatgttttaaatagtgttctttttttaaccactctaaacatgctatgttttcattgaatagtatgcttttaactaaaatgtttcctaagtattttgaaaaaatgtttgcagtattttcttatacctcaaacccacctcacaggaactaaagcaactttagtatgaagtctgacaaattctgtacaaaacttagatattaaccttgacttttattctacaatgaagctacatatagaattaaataaattattaatacgaa

SEQ ID NO: 6780 - DNA, 5426 bp, Homo sapiens
ggcaaagggcctcagccccgccctactgactgtgaattctacaacatatggagcgcctaccttgtgcaaggcattgtggcccttcagagacttgaagacagtgtgtgactctcctgtgagttaagagcactggctgagtcagacagacccgagtgacaagcccagcttcgctccctctcagcggtgagagccaagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatgaaaaaaga

SEQ ID NO: 6781 - DNA, 532 bp, Homo sapiens
ggaaaggagacgtgcccactggagagcaagtcagaactttcgtgagccctgctccaggtcccaggagaaagtgccagccatgaggactggagtattgcctgcccttcagagacttgaagacagtgtgtgactctcctgtgagttaagagcactggctgagtcagacagacccgagtgacaagcccagcttcgctccctctcagcggtgagagccaagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtcc

SEQ ID NO: 6782 - DNA, 5225 bp, Homo sapiens
agattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatg

SEQ ID NO: 6783 - DNA, 3095 bp, Homo sapiens
agattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctg

SEQ ID NO: 6784 - DNA, 4339 bp, Homo sapiens
ccgcagtccgctccctcccgctccgctcgcccctgcccgcccgcccgcccggtcgcgcggtcgccgccgccaccgtgtcgcccgcatcctccgcctggcgcctccgggccccgtgcctccgcccgccctctccggccccggcgacgaggtaacgcgccctgggccgagccgccgggccctccgcccagagcgccgccctccgagctcgccccggtgggtgtggcccggcctggcccgtgccccgctgccgcacttcggtccctcccgagccccgccgccgcatttcggcctcctccggccgcccgtagttccagttcccctttccccaccacggagccccagggcccctgggcttgtcgagatgtctgaggcgtcaggaaatctcaacagcctccgcatggcgaatgtggccctgcgcgaagaattaaatgcccttcgcggggagaatgccaatttgggcctccagctcgggagagccctggccgaggttaattccttgcggggcaatgtctccagctacatccgctggccagtacccatagtgcccgtccttgcggaggagaacttggagttcgcgctcagtgagatcgaagtcattcccgggggagaactgcccttcttgtgccggcctcccccacgcgcggagcccgactgtatctcggatgatcttttgattaacgtgatccaggatcgcagcacccccgacgggcccgctgacccccctctgctgcccatcccgcccccgccggcgctgcctccgcccgcgtcaaaggaaccgcccccgcaaccccctctggcaccgctggagcggcctgagatagagcccttttcaggagacccagtctacctggctgaattcctgatgcagctagagaccttcatagccgaccatgaggttcatttccccgggggcgccgagcgggtggcctttctgatctcctttttcactggcgaagccaaggactgggccatctcggtcacccaggaaggaagccccttgcatgccaacttcccgcgcttcctggatgaaatccgtaaggaattctgtggccccatccccccacgtgtggctaaaaaggccattcgcaagctcaagcagggccactgtaccctcggcagctatgcagatgcttttcagttcctggcccaattcttgtcttgggatgactgccgcctccaaaaccaattcctcaaaggcctgtcggaattcttccgcaaagagctcttatggtcaacagaaatggccgacctggatgagctgattctcgaatgtgtggagatagaaagaaaagtgcgcgttcccaagcctatcccgctccctggagttcgaaatatcatcttcccttttgctccgagtcccaatgaggaagaaagtgaagatgaagagtactacagtgaagatgaagaccaagaggcacgcaggcacaggcttcactccaaggaccagaggaagcgcatgagggcttttcagcaagagatgaaggagaaggaggaggaggagatgaagaaggaggaagaaatgaagaagaaggaagagaaggaggaggaggaggaagaggaaatgaaacagaaagaggaggaggaggagataaggaacaagaatgaggaggaaggagagagtaaggatgaagaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccaactgattcgccgcacaggtcgtttaggacaacgccaagttcgaagacgcccccctgtgcttttccgcctcactccgagacaggggggccaccgagctgctcgtggccgaattcgagtttgagtgctggggccagatggccacccagaacacacccttcttttgcatcccccgcccctgctattgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgacccaccaggacttcacccaatgcctcactgatctgccccaatgagcaagaggacaggctaccctgaactcctaaagccactgaggccagttgctagatataatcgatggtgagcaggatggtatccagaaatgtccctagaatcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcctaaagggtagccagttagggttccggagaggagaaggaggaagaagaggaggaggagaaagaagcagcaacgatcattctgccattgtaaagagtgactctttccttagggatggtggtcttctccccttgccaggccttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggtttgtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggagctgattttatctgatttcctcaagagtgcattccagaaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtggggggaggggatgcatgcaggggtatgaaggcagcccaaggtctcccagaggctcgggaggaaacccttttggaatacatgtgttattgttgcattactgtgttgtgaagataagaagctgctctgtatgctaaagctttctctcctcaataaaaatataaagggtgtgtaaa

SEQ ID NO: 6785 - DNA, 4359 bp, Homo sapiens
gatcctgccgcagtccgctccctcccgctccgctcgcccctgcccgcccgcccgcccggtcgcgcggtcgccgccgccaccgtgtcgcccgcatcctccgcctggcgcctccgggccccgtgcctccgcccgccctctccggccccggcgacgaggtaacgcgccctgggccgagccgccgggccctccgcccagagcgccgccctccgagctcgccccggtgggtgtggcccggcctggcccgtgccccgctgccgcacttcggtccctcccgagccccgccgccgcatttcggcctcctccggccgcccgtagttccagttcccctttccccaccacggagccccagggcccctgggcttgtcgagatgtctgaggcgtcaggaaatctcaacagcctccgcatggcgaatgtggccctgcgcgaagaattaaatgcccttcgcggggagaatgccaatttgggcctccagctcgggagagccctggccgaggttaattccttgcggggcaatgtctccagctacatccgctggccagtacccatagtgcccgtccttgcggaggagaacttggagttcgcgctcagtgagatcgaagtcattcccgggggagaactgcccttcttgtgccggcctcccccacgcgcggagcccgactgtatctcggatgatcttttgattaacgtgatccaggatcgcagcacccccgacgggcccgctgacccccctctgctgcccatcccgcccccgccggcgctgcctccgcccgcgtcaaaggaaccgcccccgcaaccccctctggcaccgctggagcggcctgagatagagcccttttcaggagacccagtctacctggctgaattcctgatgcagctagagaccttcatagccgaccatgaggttcatttccccgggggcgccgagcgggtggcctttctgatctcctttttcactggcgaagccaaggactgggccatctcggtcacccaggaaggaagccccttgcatgccaacttcccgcgcttcctggatgaaatccgtaaggaattctgtggccccatccccccacgtgtggctaaaaaggccattcgcaagctcaagcagggccactgtaccctcggcagctatgcagatgcttttcagttcctggcccaattcttgtcttgggatgactgccgcctccaaaaccaattcctcaaaggcctgtcggaattcttccgcaaagagctcttatggtcaacagaaatggccgacctggatgagctgattctcgaatgtgtggagatagaaagaaaagtgcgcgttcccaagcctatcccgctccctggagttcgaaatatcatcttcccttttgctccgagtcccaatgaggaagaaagtgaagatgaagagtactacagtgaagatgaagaccaagaggcacgcaggcacaggcttcactccaaggaccagaggaagcgcatgagggcttttcagcaagagatgaaggagaaggaggaggaggagatgaagaaggaggaagaaatgaagaagaaggaagagaaggaggaggaggaggaagaggaaatgaaacagaaagaggaggaggaggagataaggaacaagaatgaggaggaaggagagagtaaggatgaagaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccaactgattcgccgcacaggtcgtttaggacaacgccaagttcgaagacgcccccctgtgcttttccgcctcactccgagacaggggggccaccgagctgctcgtggccgaattcgagtttgagtgctggggccagatggccacccagaacacacccttcttttgcatcccccgcccctgctattgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgacccaccaggacttcacccaatgcctcactgatctgccccaatgagcaagaggacaggctaccctgaactcctaaagccactgaggccagttgctagatataatcgatggtgagcaggatggtatccagaaatgtccctagaatcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcctaaagggtagccagttagggttccggagaggagaaggaggaagaagaggaggaggagaaagaagcagcaacgatcattctgccattgtaaagagtgactctttccttagggatggtggtcttctccccttgccaggccttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggtttgtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggagctgtttttcagctgattttatctgatttcctcaagagtgcattccagaaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtggggggaggggatgcatgcaggggtatgaaggcagcccaaggtctcccagaggctcgggaggaaacccttttggaatacatgtgttattgttgcattactgtgttgtgaagataagaagctgctctgtatgctaaagctttctctcctcaataaaaatataaagggtgtgtaaaga

SEQ ID NO: 6786 - DNA, 2028 bp, Homo sapiens
atgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccaaggaggcggccccggaggcaagccgccatttgggagcggagcagagcccggccggtgctcccgaaggcagcaagatgttgcgagccacagctccctgctggttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcgtgcatccttaccgagtttgagtttgaagaaacccattatcctccgaagctctgggtgccaagtccccaccgtcctccgccgaggctatctccagctgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaaggtccgacagcgcgcccagatccagccacgccaccggtccgcctctcccgccgccctggcctgtccttag

SEQ ID NO: 6787 - DNA, 2028 bp, Homo sapiens; identical to SEQ ID NO: 6786

SEQ ID NO: 6788 - DNA, 4401 bp, Homo sapiens
acgggcagccgttaggggcggggtctgcagccgcccgcgcgcggctcgcgccctcccctttgtgtcgccatggcggcggcagcggcgacgagaacggcgagcgaggggtcgagcgcggccggggcctgaggaggctacgcgaccatggtggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcccagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtg

SEQ ID NO: 6789 - DNA, 741 bp, Homo sapiens
atgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggaggtgggcctgggcagggggcttggagattccgagtgggtgagggggtgcgtgtgccaccacgcccagcacagagagattttagatggcaaccgtgtggcatctgctgtggaggatgaaggtgcagaggtggatggggaagccttcaggtggggaagcctttgggtgggagagtcctgggacatgtga

SEQ ID NO: 6790 - DNA, 3918 bp, Homo sapiens
acgggcagccgttaggggcggggtctgcagccgcccgcgcgcggctcgcgccctcccctttgtgtcgccatggcggcggcagcggcgacgagaacggcgagcgaggggtcgagcgcggccggggcctgaggaggctacgcgaccatggtggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctgaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcccagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtg

SEQ ID NO: 6791 - DNA, 4219 bp, Homo sapiens
acgggcagccgttaggggcggggtctgcagccgcccgcgcgcggctcgcgccctcccctttgtgtcgccatggcggcggcagcggcgacgagaacggcgagcgaggggtcgagcgcggccggggcctgaggaggctacgcgaccatggtggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtg

SEQ ID NO: 6792 - DNA, 4752 bp, Homo sapiens
gccatggggctgcccactctggagttcagcgattcctacttggacagcccagatttcagggagcgcttgcagtgtcacgagattgagctggagcgaaccaacaagttcatcaaggagctcattaaggacggctctctgctcattggggcgttgaggaatctgtctatggcagtgcagaaattttcccagtcattgcaagatttccagtttgaatgtattggtgatgctgaaacagatgatgaaattagtattgctcagtcactaaaagaatttgcaagactactcattgcagtagaagaagaaaggcgaagactgatccaaaacgctaacgatgtattaattgcaccacttgagaaatttcgaaaagaacagataggtgcagcaaaagatggaaagaagaagtttgacaaagagagtgaaaaatattactctatccttgaaaagcatttaaatttgtccgcaaagaaaaaggagtctcatttacaagaggcagatacacaaattgaccgagaacatcagaacttctatgaagcatcattagaatatgtctttaaaattcaagaggtccaagaaaaaaagaagtttgaatttgttgaaccgcttttgtcatttcttcagggcttatttactttttaccatgagggatatgaacttgcccaggaatttgcaccgtataagcaacagctgcagttcaacttgcagaatacaaggaataattttgaaagtactcgacaagaggtagagcggttgatgcaaaggatgaaatctgctaaccaggactacagaccacccagccagtggacgatggaaggctatctgtatgtccaggagaaacgaccgcttggttttacatggattaaacattattgtacatatgataagggaagtaaaacatttacaatgagtgtttcagaaatgaaatccagtgggaaaatgaatggccttgttactagctcaccggaaatgtttaaattaaaatcttgtatccgacgaaagacagattcaattgacaaacgattctgctttgacatagaagtagttgaaaggcatgggatcatcacgttacaggccttctcagaagctaataggaaactctggcttgaagccatggatgggaaggaaccgatttatactctgcctgccattataagcaagaaagaagaaatgtatttgaatgaagcagggttcaactttgtgagaaaatgcattcaagctgtggaaacaagaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttaaatctgatgatcaaaactacagggtggaggctgtacatgcattggtgcacaaattgccggagaaaaacagagagatgctggacatcttaataaagcatctggtcaaagtatcactacacagccaacaaaatctcatgactgtctcaaatcttggtgtcatatttggcccaactctaatgagagcacaggaagaaactgtggctgctatgatgaatattaaatttcagaatattgtggtagaaattctgatagagcactatgaaaagatttttcatactgctccagacccaagcattcctcttcctcagcctcagtctcgatctggatcccgaaggacacgagcaatctgcctctctacagggtctaggaagcccagagggaggtatactccatgcctggccgaacctgatagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaaaagcaataatgtatatgatatctataaaggaagcaaaattaagtcatacactgattccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatatttaccaatgatggggaaactgtaaaactacagtatcaaggcatacaacttaaattccacttggaagattgtaaagtgtcaaagtattttaatgataatttaatttgggcttttgaaatgttcttctacaaatgaaaaagatgtttaaaaacgttacaagggaagctatgccttctgaagtctatccttagttgaaacagaaaataaacacaaaggtacaagatccttaaattattttgaaccacagaggttgaaattgttttgtgatcttcagcagaaataaaatctgtacatgattttcttttatgccttttagtttacagtctttattagcaatttcagtgaatttgtagagcatagtaataggtatttactgtccacttatatatatcagcatctggtcatgcacgaaccattaattctatatttctatttcaataattctaatatattatttctataaatgtaatatctgtatgtggcaaagagcctttcttctcaagatcctgaaaagctggttacctgccctttgagtgccacagtcctgaactgcttgttcttgacatcttgcatattacttcagagttccccactgtgcagactctcaggtattaactgtaaaaaactctttacatgccattattatctgtaatctctatctcttctactttaaattaatgtttctagaattaataggttaaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtcgaggtccttggtgaccttagtagtaataacagcattgctgacaccctaattgccctctgctggaacagaaggtagttttccagtgtaccagtcccttagtctatacagcacccttggtttaagcacacttgccatcatctggtatcctgctagactagaatctcttaaaagcaaattggttttctttcaaagaccaacttgactccaaagagagattcagaatcctacttctcctgctgctgcataaagaatctcaaccttcattttatttgaacacggac

SEQ ID NO: 6793 - DNA, 3649 bp, Homo sapiens
ccccggaggcgctgcacatgagcaggcagccccgactggaaggagcccggggccctcattccttctcctccactgggaactgagtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttg

SEQ ID NO: 6794 - DNA, 1709 bp, Homo sapiens
gtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctggtaagcagagcccagggcctctaggggcagtggggagggggtggccattatgagtggggccctctgctcaggctcagggagctctaaggtaccagtgggtaatgcaaatgcagtccccactaatggctaggatggcagggtaggcggctgaagaaactgccttctgtaagtctgtgaatccagccctggggttggccctgcaggaagactctccaggtgagggtagggcacattctaaaggaagttcccatttcacgggaggcagaaggccaaataaatactctgcaagccaaccaatggcaggctgaaactagcagataaaattttaaaggattgatttcaatagtcgaccatttttttaaggctgaaaacaccaattgcataagtagagctaggacaggggccctctgacaactactgacctggaaatgacct

SEQ ID NO: 6795 - DNA, 2168 bp, Homo sapiens
gtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 6796 - DNA, 2589 bp, Homo sapiens
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtcctcacccgagccccgcggcccctgagccgctcgcctacgactaccggtttgtgagcgcggcggcgaccgcgggccccgacggcgcccccgaggagtccggaggccgaaccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 6797 - DNA, 1376 bp, Homo sapiens
ggaagttctgcccggcgctctccgccggtgcctccctggttatattgttgaacaggaaacccggcagcgcgggagccgcacagtcgaggagggagggcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggccgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtcctcacccgagccccgcggcccctgagccgctcgcctacgactaccggtttgtgagcgcggcggcgaccgcgggccccgacggcgcccccgaggagtccggaggccgaaccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactg

SEQ ID NO: 6798 - DNA, 4201 bp, Homo sapiens
agaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggatcttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgag

SEQ ID NO: 6799 - DNA, 4094 bp, Homo sapiens
aggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggatcttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgt

SEQ ID NO: 6800 - DNA, 2398 bp, Homo sapiens
actcagccctgggaggtgactgagagtggaggggattcaagggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggatcttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctca

SEQ ID NO: 6801 - DNA, 5254 bp, Homo sapiens
agaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttgt

SEQ ID NO: 6802 - DNA, 3929 bp, Homo sapiens
aagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaa

SEQ ID NO: 6803 - DNA, 2353 bp, Homo sapiens
ggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 6804 - DNA, 3781 bp, Homo sapiens
ggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctgtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 6805 - DNA, 4300 bp, Homo sapiens
gtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaacttccaacttgaagtcattccccgagtataatactgagcatgttcatatttaacatggatttgaattttatgcttcctaggcatttaacttattaactcatccagtgttcttaaactaatatacactatgttaggggccagttctgtcttgcttcatgtcttccaaaaaccctaaggcaatatctaacatcccttaaggcaaaggattaattaacagaactgtattttatatgttgcatatctgagttatggagaatttgtgcttaaaccatgattcagaaggttcaaagcttaaaaacacattgatctccaaacttgttctgtggttatggaaatcagtaaagggaacaaggatttctgtagaaactggggagagaggaaggcaaagaaacattttcccttgtgtgggttgagctgaggatggaaacagtccagtctgtgttttattgagtactcagtattcaagacccactcgtgatcttgagtgtcacacacactcacaaccagatggactaggaaaaaagcagtgatttagccacatcttgttaaaaagactttctgcagcctgaaaagaaggtggcaatagcaccaaaacttcaatggctcacacacagcagttgctacaaacagcaggtcaaagtgaaaattcaggattgcagcacttgactgttttcctattttgtaaagaaaccaagctcttaaagcttagaggaatcagattgcaacgaggcctgcctggctctggggtgataaaatgtgctctgtttccacatggatatgtgcaagatggtcagcatccttgatatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaac

SEQ ID NO: 6806 - DNA, 2620 bp, Homo sapiens
gtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaaaaatgggaacgcaactggtgaagatttctgtggtccttggggctggtggtga

SEQ ID NO: 6807 - DNA, 4484 bp, Homo sapiens
aggggaagtcaagcctctctactgcttctttttataacctttaagttaattcagaacccagataagccttgatctgaggatgatataaccaccgcaggcaacatgggaacttctagagaaaacaagaagaagacttcaaaaaacatgctgtgatgtctcccagtggagacagggcacgaggtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaacttccaacttgaagtcattccccgagtataatactgagcatgttcatatttaacatggatttgaattttatgcttcctaggcatttaacttattaactcatccagtgttcttaaactaatatacactatgttaggggccagttctgtcttgcttcatgtcttccaaaaaccctaaggcaatatctaacatcccttaaggcaaaggattaattaacagaactgtattttatatgttgcatatctgagttatggagaatttgtgcttaaaccatgattcagaaggttcaaagcttaaaaacacattgatctccaaacttgttctgtggttatggaaatcagtaaagggaacaaggatttctgtagaaactggggagagaggaaggcaaagaaacattttcccttgtgtgggttgagctgaggatggaaacagtccagtctgtgttttattgagtactcagtattcaagacccactcgtgatcttgagtgtcacacacactcacaaccagatggactaggaaaaaagcagtgatttagccacatcttgttaaaaagactttctgcagcctgaaaagaaggtggcaatagcaccaaaacttcaatggctcacacacagcagttgctacaaacagcaggtcaaagtgaaaattcaggattgcagcacttgactgttttcctattttgtaaagaaaccaagctcttaaagcttagaggaatcagattgcaacgaggcctgcctggctctggggtgataaaatgtgctctgtttccacatggatatgtgcaagatggtcagcatccttgatatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaacataa

SEQ ID NO: 6808 - DNA, 2431 bp, Homo sapiens
caggggcgggccgcgggtggggcggccgggcctgcgctggggacggctctggggactgcggccggcgccgggacctggaggggacgctggggccgaagcagcatgtgacaccgaccaggattcagccctgatggaggctgaggaggcccagcatggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttccaaatgtttagggattttcatatctttcttatgctgatttccaattggattccctacaatgatttctggttttcatctgctctggatgattactatctcttttaaatttgttgtggcgagttttagggcctaggacagctctatcttgccatgtgtttcgtcagcactcaaaaaaaatatgtgtattctgctgttactgtgtggaatattctgtaaatgccaaatagattcttttggttaatggcattttgagttgttttatattcttgttgattttcttttttttcctctttttaaaaacatgaaatgcttcacaaaattttgtgtaatctatattcaagaaccattttaatcttgttggcatcattctgattttagaaagtgctgccaaagccaacactccttgctgattttctgtctagttctatcaattattgaaaaaggcatgaggaaatttctaactataattgtggattcatctatatctcctttcagttttctttttttaaaaaaaatcaatgaaaatttattaaattaagcataaagttactttcacatttatctacaaccacagtgaatacagttcttggcatgaagacaccacaacctttagaatttaaagcctcctcacctgcaagattacatatataaaactcccactattgtttctctaagagtggattagttcaccaagttaaaagttatatgatctagaatataataaaatggaaatgatttactcataa

SEQ ID NO: 6809 - DNA, 1718 bp, Homo sapiens
cagcatgtgacaccgaccaggattcagccctgatggaggctgaggaggcccagcatggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttccaaatgtttagggattttcatatctttcttatgctgatttccaattggattccctacaatgatttctggttttcatctgctctggatgattactatctcttttaaatttgttgtggcgagttttagggcct

SEQ ID NO: 6810 - DNA, 1878 bp, Homo sapiens
gccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagccactatggaaggaggggtcaggattacagcagaggagactggcacacagagtgttaagtgacacccactcaatccaccccgaagctgttacacttaattaaccctcaaactgcccagtgagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctgacctgc

SEQ ID NO: 6811 - DNA, 3683 bp, Homo sapiens
cgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagcccagtgatgggagctgtggcctcttcacccacacacagaaggatgccagtccctctgtcggtctgaggtcagcttcctggggctgccccaccctgagggctccttacagggtgctcctcacagccatcccatctgtacccccgggctctgtccaccctgctgctgccctgggcacagaccctgaggtctcagtcctgcctccagccaagtttctgcctggtgcccagtgattcctgctgggcaccccttcgctcactgcccctccaccatgcagcagccagacacacccacagcacccgcagacctctaggccgggtcccagacatggccttcccccaaaatacttcctgctgtcctgtctgtgcacagagcaagggactccccacctctgcgccctgtgctggtcatcatgggctctgtgctggtcaacccagcaagtgtcccgtttgcccaggagtccctggtgtcgtggcccaggtctcatggtggccctaagcctgccagccctgctgcccgccttgctgtcctgctctgagcatgggtgccaccctccagctcctgggcgtgtcacttctctctgagcctggggcctgcatgggcccccagccctccccagcctgcttgggccgctcctgctggcctccacaggccgtgagctgtcagtgtctcaagcaggggaagtgagggctgcctccaggcctccgtgtactgggtggacaatggcccccaaaggccgtcggcaagaacaccacctccaggacccctacagcagtgggctcaggacttgggcaccaagaggagagggtgggaagggctgcagagtcagggctgcacccaagaggagccacggagccggagccggagcggaggcccccaccgagggccccagggcctggcaggttccggaagagacagggccagcgggagtcattccctgcagccactagggggcagccgccacccgctcagcagccctgggaggcggcacgggcaggtgcgccttgggagggctgaggcaaagaccccgggtagaaaggcggcccccagctctgcgagacccctgccctcttgtccagtcccttccgagggtccgcaggtgagagcagcctgccctgcatcccaggctctggttccagggtccagggccctgcgctgccacctccctcgtgcttcagccaagaaaatgggggtgcaagtagggtgtttggggtcccagagacgcaggcgccgcggcgcgatcttcctgggcaggagggcagggctccccaacctgcctgagccggggtgggggtccaggtcccccacttgcccttgtgggaaaatccctgtctcagcagaatgggccaaggtcacgcaggtctccccagcacgtgttaatttggttaataaaactgtggatcaagga

SEQ ID NO: 6812 - DNA, 864 bp, Homo sapiens
cgggcgaccggcaaatgtcgcgagaatacgtccaggcctaacgggattttcgccttccggcaggagtgggaccaggggcggggactgatgttgcgtatacgaggagcgagctgacgactggcgtggtgcctccgcccccctttcttgttgcatggcaacaacaaacacttgctcctgcggaccagatccccggaggagttgttgctgggcggagtcagagcagttcttgagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacag

SEQ ID NO: 6813 - DNA, 1416 bp, Homo sapiens
cctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacagatgcgctcagtaaccagctgcgcctcgccatggatgcacaggccacccatctggccaggctggaggagtcctgtcgtgcggccatgatgtgtgccatggccaacgccaacaaagcgcaggcagctgtgcaggctgggcgtcagcgctgtgagcgtcagcgtgaacagaaggccaaccttgcggagatccagcaccagagcacgagtgacctactgactgaaaacccccaggtcgcccaacaccctatggctccctaccgggtcctgccctattgctggaagggcatgactccagagcagcaagctgccatcaggaaagagcaggaagtacaacgctctaagaagcaagcacaccgtcaggctgagaaaacactggatactgaatggaaaagccagactatgagctcagcccaggcagtgctggagctagaagagcaggagagggaattgtgtgctgtatttcaaaggggtctaggatccttcaaccagcagctggctaatgagcaaaaagcccagcaggattacctgaattcagtaatctacaccaatcaacctacagcccagtatcaccagcagtttaacaccagcagccgctaagttcaggatgtctatctctctctcccttctcctccatcaagctcacaggtggttaggagtcaaagagaaaaatgctgcatactcccaccttctaacctaggtaataaagttctgcactcaaaa

SEQ ID NO: 6814 - DNA, 1006 bp, Homo sapiens
acttgctcctgcggaccagatccccggaggagttgttgctgggcggagtcagagcagttcttgaggttcaaggaggcgggggagacctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatgatgcgctcagtaaccagctgcgcctcgccatggatgcacaggccacccatctggccaggctggaggagtcctgtcgtgcggccatgatgtgtgccatggccaacgccaacaaagcgcaggcagctgtgcaggctgggcgtcagcgctgtgagcgtcagcgtgaacagaaggccaaccttgcggagatccagcaccagagcacgagtgacctactgactgaaaacccccaggtcgcccaacaccctatggctccctaccgggtcctgccctattgctggaagggcatgactccagagcagcaagctgccatcaggaaagagcaggaagtacaacgctctaagaagcaagcacaccgtcaggctgagaaaacactggatactgaatggaaaagccagactatgagctcagcccaggcagtgctggagctagaagagcaggagagggaattgtgtgctgtatttcaaaggggtctaggatccttcaaccagcagctggctaatgagcaaaaagcccagtgagttctaggtggtagtggtggagataaatgccaagggagggagaggagggat

SEQ ID NO: 6815 - DNA, 1949 bp, Homo sapiens
gttgctgggcggagtcagagcagttcttgaggttcaaggaggcgggggagacctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacaggtaagcagcccggccctccagactcagagacctgaggcctagtggggatctgtcctaagctgagtacagcagccaggggaccagaactgtgtggggaggtccacttatccatagggttggtgctgaaatgttaggttgtgcagaccccaacctccctgacttccttcagtaactgacagtgtagcattgttcttgattagtttggcactccattacgtggaggcagcacagtgcagacagacctaatggctctgccacttactagctggtttgggcaaatgaattttcccttctgtgcttcagtttcttcatctttaaaatgagaataataatttataccacatagagtagctactattatgatattgtctgtggccacatccttctcttccattagaagaagcccttcaagggcaaggaccatgtcttatctacttgcactgttcacccttcacatcaaccctgttacagcactctgttctgctggaccacttattgtagttgtagctaattgtgaaagtatttgtttaatatctgtcttctccctaaaatgtcagcctactgaagatgaaccatctctttcatgtctacccatctcccagttgcatagtacagtgtctgacaggtcttaggaacagcaaggagctcagtgtggctggagcagaaaaaaattgtcagtacctttgctcatgccatgccctcagcctggaatgccctttgctcttttagcctgtatacaaaatgtatttcaaggatcacctcttcctggaagccttcctcttttccaccatccaaaaccctcttaataccctgtgtacatccctgccattgctcttgccagattgtggtctatgtttgatctgtgtccccaactagacagggagttctctgaggacaggatttaattcgatggtatcattagaacccagcacatggcccttagactgagattcagagatatgaaatgatttacccaaaatcacacagctcagaagcagcagaactgacattgggacccaggtccattggaggcatcttttagttatgcgcttgagaaatcgttgttgctgcacctagttccttccacatccctacaactcggacactaaccccctcctaaacattcgtacacacacaaacacaaaacttgctgaacaaatggctggatgagtgaaacaggaatggagcaagccagtacagt

SEQ ID NO: 6816 - DNA, 1478 bp, Homo sapiens
gagttgttgacatttccgagagagcgggagcgtctgtacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaactttgctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataatgaggaacacacccttgttcccgtcattcacgtataaagagtggctaccttaaagagtcacgtttcttttttaaagatacactccttgggccacaagtacccttcagctgtaatcgtccactgtggacaaaaca

SEQ ID NO: 6817 - DNA, 1394 bp, Homo sapiens
gttgttgacatttccgagagagcgggagcgtctgtacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaactttggctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataatgaggaacacacccttgttcccgtcattcacgtataaagagtggctacctt

SEQ ID NO: 6818 - DNA, 791 bp, Homo sapiens
agccccgtgccaggcaaggcgggtcaccgggcagcgtcggggccctcttctgcctcggggtctcttcacggagggcgccctgcggcgacagctttcgccggccgcgcgcacggcggtcggtacctgttaaggacgagatgccttccgaccaccggataactcgggacggtccctgatttgcctgctccctgtccaacagcatcttcggctcactcggaagtgaaaacatgcaatttcatgttataacatgcaatttcatgtcataaattattcccactgacgcctgaacatttttcctaaaagggatctgcagtcacaaggcgccgccttccggaatttagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcc

SEQ ID NO: 6819 - DNA, 790 bp, Homo sapiens
ctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaa

SEQ ID NO: 6820 - DNA, 584 bp, Homo sapiens
ctctttccctaagcagcctgaggtgatctgtgaaaatggttcgctattcacttgacccggagaaccccacgaaataacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaa

SEQ ID NO: 6821 - DNA, 758 bp, Homo sapiens
tggcttcgggggcgccggcctccaggcccccgggaggagaactcctagggctactaaatcctcgctggaggcggtggcttcttatgcgggaggacgtggcggagggcctgactttgggagccgggggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaa

SEQ ID NO: 6822 - DNA, 829 bp, Homo sapiens
tccactgcttctcagccagccaacgcctcttctgattggctctgacgtgcgtggtgcgtgaaaacgtcacgagacgccggcgttactataagagcgcagccgtggcgcttgcgcgcctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 6823 - DNA, 997 bp, Homo sapiens
gttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttct

SEQ ID NO: 6824 - DNA, 3801 bp, Homo sapiens
gctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcccgcccttccttcctccagctggctggagattattagccaggagacagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaaccgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggaggttacagtaagctgagatcttcccactgcactccagcctgagcgacagagtgagactccatctcaaaaaaaaaaaaaaagtgtgactattagctgggcatgatggcatgcgcctgtagtgccacctactcaggtggctgaggtgggaggatcatttgagcccaggagtttgaggctgcagtgagctatgactgagcctgagcaacagaatgagaccctgtctctcaaaaaatgtgggactgtctctggcagttgggtcacctaattgtgcctggccccaagaaggaggggtgggtacttgaggatggtaaagaacctccccaccaaaggtctctgtttcttaaattctgattacatgtgtccccaggcctctagggactgatcactggagcatgaggcctgatagatcctggtggtcacttgttgggcctgggggcagaccaggggtctttcccagtgcatgagaagagatgggtgaggtgggaccagagtgggcgacagtggctggacaccagctgcctgagccccgccttacctctttgagggtggatttcattgtgtctatcatgaacgacagggactccttgtcagagtaattctctcttggatcaaaatatccgtggactgctctggaaagtgaggagttgggggttgttggggttcatcttagaaccgcctcccagcggtgcccccatcctgccctgggttcaggcctctgaggagaaaccaaagcctgggctaccccaactcccacagctgggtcccttgaccctgggttggatttgaggctcagttaatctcagctcacgctcagctggcacaagccaggcgcaagcaagtgctgaaggcacagccttgctggggcgcagggagttcaggacttggtcacagtcagccctgaacagcagagctgggatctgaacaggcgctggagcccacacttgctctgagagagaatttatgtcttcacaatcctcccattgaaagtctacaatcctggccgggtatggtggctcacgcctgtaatcccagcactttgggaggctgaggcgggtggatcacgaggtcaggagatgagaccatcctggctaacatggtgaaaccctgtctgtactaaaaatacaaaaattagccgggcttggtggtgggtgcctgtagtcccagctactccggaggctgaggcaggagaatggcgtgaacccgggaggcggaccttgcagtgagctgagattgcaccactacactccagcctgggcgacagagccagactccatctcaaaaaaaaaaaaaaa

SEQ ID NO: 6825 - DNA, 1072 bp, Homo sapiens
ctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagt

SEQ ID NO: 6826 - DNA, 2722 bp, Homo sapiens
cgggaccagctgcttccggctgggctgcgggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggccgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagaactgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttcctttttttttttaattcaggaccatctttggtgacaaatataaatatcaatactatatatatcaccaatatacatatttgctttgctaaaaggtttctgtgtcttcaggatagtttacttgcaagcctcatgtttttataaaaacgtgggtgctacctgaataaaactaatgcctacccgttggcggttttgtgaagactaatgaactattatattcaaagggtccaagcagtaggcatttactaaaggacagctagttttatctgttattattctgccattcagagagataccaaaactactctctaaggcatttctcttccctgcatgtaaaagcaagggtgtcatacttgagataagcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaacatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagatttttaaaaacg

SEQ ID NO: 6827 - DNA, 2587 bp, Homo sapiens
ctcgtgcagtagcgtcacgcggaggcggagcgaggactcggggacagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagatttttaaaaacgttttagaactttgtgaatgtaggcacaactaagtgtctcctataaatattatagagaggagatctagggttttgttccttggagttcccgagcaaggttgatgttcagttggttcaccctggttttatcatgtcagttatttatggtcagtaccattcagttgcaatgatggtcataccgtaccagttgtaatgtatttaaaataacaccccaagcacccaccatgcaaaaatcagcagcacatagtggtgatttttgcatggtcagtgctcatgcaaaaatcaccactatgtgggaccagaaatagctaaaatgagtagatgatgaattcagagtgagaagaactgtcaagattggaacctagtctcaaagcacagtagtatttttaaaggaatagaattaagaatctaaatctaatacttaacattctaaggagccgacctggactctttctcttggttattataaaaatagtaaatgagtaaggtccgtatagtaaagactctgcttacttacctttactacatattattacacttccttttctgttggagtttggatagcatgagtagcacttggtcctcatttctcagacaaccaacgaaccagacttgggctttttatagatactgtttgtggtagcagctacttactaagtacagaaaatgtactatctctcaggaaggtacatcccagtctattctatcatgtgataatccttcaatgcccagtcaggtcttaacacatgtccagaatataaagtgtacagaagaaatcaaagtactttcttcaggcaaaaactagccctggtttgcaggaataattacagaaatattttctcataggagccactggcaataatgagtagtgtgcacttgatttttcattctaaatttgtatctctaaatctagaaataaaaatcatatcatgtactgtcttca

SEQ ID NO: 6828 - DNA, 2788 bp, Homo sapiens
tgcgggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggccgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagaactgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttcctttttttttttaattcaggaccatctttggtgacaaatataaatatcaatactatatatatcaccaatatacatatttgctttgctaaaaggtttctgtgtcttcaggatagtttacttgcaagcctcatgtttttataaaaacgtgggtgctacctgaataaaactaatgcctacccgttggcggttttgtgaagactaatgaactattatattcaaagggtccaagcagtaggcatttactaaaggacagctagttttatctgttattattctgccattcagagagataccaaaactactctctaaggcatttctcttccctgcatgtaaaagcaagggtgtcatacttgagataagcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagattttt

SEQ ID NO: 6829 - DNA, 615 bp, Homo sapiens
gcacgtctggagctctggctcgtgcagtagcgtcacgcggaggcggagcgaggactcggggacagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaacatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaagga

SEQ ID NO: 6830 - DNA, 1295 bp, Homo sapiens
gcggccgcccgcgagcggggcggtgccacgtacggctccggaagaagcgacggaatctgctagggcacaagagagacgggcgctcgggctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggaggagctgaggggcaaggaggatgacaagatctatcggggaatcaacaattatcagaaatacatgaagcccaaggatacgtctatgggcaatgcctcttccgggatggtgaggaagggccccatccgagcgcccgagcatctacgtgccaccgtgcgctgggattaccagcccgacatctgtaaggactacaaagagactggcttctgcggcttcggagacagctgcaaattcctccatgaccgttcagattacaagcatgggtggcagatcgaacgtgagcttgatgagggtcgctatggtgtctatgaggatgaaaactatgaagtgggaagcgatgatgaggaaataccattcaagtgtttcatctgtcgccagagcttccaaaacccagttgtcaccaagtgcaggcattatttctgcgagagctgtgcactgcagcatttccgcaccaccccgcgctgctatgtctgtgaccagcagaccaatggcgtcttcaatccagcgaaagaattgattgctaaactagagaagcatcgagctacaggagagggtggtgcttccgacttgccagaagaccccgatgaggatgcaattcccattacttaggtttcccataattcttaaatttaaaaaataaacgttttgttcttttgg

SEQ ID NO: 6831 - DNA, 1376 bp, Homo sapiens
cacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccagaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatga

SEQ ID NO: 6832 - DNA, 6020 bp, Homo sapiens
aggtcatttttgcagcttattgtgatgacaacagtggaggatggtcttccacttcaccttaaaagcggctgttctctgattatcattaagcatggccacgcccgcacttaacttctgacagtggggaaagcagctgtgtgtgatagcttggaaggtttactgctgcctcaagtcctcttctctgcagttgaggtttcaggtttcaatcctcccaataccacaagacagagcacggggcggctgccgcctccgcctccgcgccttaacctaggcggcttgccgaagatctcagccccgcggccgcgcgctcgccctgccctagaccagggttgggcgcagcggcggaggtggcttctgggctgcgcgagctgggagagctgggaggcggcgatcgcagctgggccgggacttccttcctccaccgcacggcaacaaaacaaccctgcggcaggcactgagtgcttcgcagctgtctgggcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtaatcccagcactttgggaggctgaagcaggcggatcacaaggtcaggagttcgagaccagcctggccaacactggtctctgtgaaactccgtctctactaaaaatacaaaaattagctggacgtgttggcgggcatctgtaataccagctacttgggaggctgaggcagaagaatcacttgaacccgggaggcagaggttacagtgagctgagatcgcaccagtacactccagcctgggtaacagagctagactccatctcaaaaaaaaaaaaaaaaaaaatccatttaaccaaattgtcttacataatactgtaacaaaacaaattttgtgttagaaaagtatacttaattctttgactttttataactgcatacataagaattcaatatttttcaaatatttatagcttatttagaaatatttctataatataagcaatttcttaaaaaccatcagatgatacttacagtataagtattcacatccagactttttagtagaaaaccctaagggctttgatatcttttttgattgtaacattttaaaaattatgaaataaaagtactgaaaaccagacacaaaatttatagctgaatgccttattataaggaaatactcttttaggactcagccagtcaccccacgtgtcctttttgtgtcctgtcacaattacaaccccacaaaagtaactgctagactgatttaaatggtaatcactttgttgcatttgattactgctgccacacctaaatgcatatatctatattttaatattatcaatttaaagttgttattaaatgtatattttattttacatctcttttttaatctagaagttcctccttctttccagttccttaaaatttacctggtgaagaacctgatcctaggacctatagagtttcccatactttgtattttgctgattgcacactcatggcacggttcagcacattgccctgtcctctcgatattagcacacagtgcaggttcaggcacattgaatttgagaagacttaggttcagtcctttggcaagactgtaaatcacggtgtctttctttccttcctccttcttctctctctctctctctctctctttccttttctttctctttttttcagagttgcactctgttgcccaggctggagtacagtggcacgatctcgactcactgcaacctccatctcccgggttcaagcagttctcctgtttcagcctcccaagtagctgggactacaggtgcacgccaccatgcccggctaatttttgtatttttagtagaggggtttcaccataatggtcaggctggtcttgaactcctgaactcaagtgatccaccagccttggcctcccaaaatgctgggattacaggcatgagccaccatgcccagctaatttttgtatttttagtagagacagggtttcaccataatagccaggctggtctcaaactccttaccttgtgatccgcccacctcagccttccaaagtgctgggattataggcgtgagccactgtgcccggcctacagggtttttatctaacctttctgttacaactgtacctctccttctgtactgaaagtcctggttttcaagaacacagggcacgatagaattagaacatcccacaattactcatttcttttatttatcttacacttacagctgtctcagaataacaatagaaatacaaccacaaataatatggcaattgaaacaattaaaaagttttcatttgcttttctcattctttcccaatttttttttttttttgagatggagtctcgcgctcttgttgcccaggctggagtgcaatggcacgatctcggctcactgcaacctctgcctcctggattcaagcaattctcctgcctcagcttcccgagtagctgggattataggcatgcgccaccacgccctgctaattttgtatttttagtagagtcaggatttctccacattggtcaggctggcctcaaactctcgacctcaggtgatccgcctgcctcggcctcccaaagtgctgggattacaggtgtgagccactgcgcccgacatcccaatttttaaaatagttatactatgtcaacattttcagaacatactggtatagcatactgtactttcttccttttatcccccatttattcttagttcttcaactatatatttaacacttgcccccagttttgttttgttttgttttgaggaggaatcttgctctgttgcccaggctggagtgcagtggtgtgatcttggctcactgcaacctccgcctcccgggttcaagtgattctcctgcctcagcctctcgagtagctgggattacaagtgggcaccaccacacccggctaattgttgtatttttagtagagatgggttttgccatgttggccaggctggttttgaactcctgacctcaagtgatccacctgtgttggcctcctaaagtactgggattacaggtgtgtgccaccgcgccaggcaattgcccccagtttttatttgatggctctgactgtttctcatatctgactctttaattatgaatccagggcatagattagtatctccatcttgtaaggatgcaaagaagccatgaaaataagtaatatcaactcctgaggataaaacgttacttgactagagttagctttttaattgtaatcatttataaacttctttgttccttacatataagcatagtcataaccatggtacccaaaattttctataagttattgtaactccttaaaggtcttgctacagttcttttatccagtacaaataattgggaaaatgtaaagctgaatgaaatctagtgagcctcatatcctcccttttagatattgattttaagtttgcttttcacagctgctaaaaagtaacaactgatttttagttccacaacctctctttcttcaatttagatggatcatacaataaagcaaaatctggctggttacagtggctcacacctataatcccagcactttgggaggctgaggtggagggtctcatgagcccaggagttcaagaccaacctgggcaatatagtgagactctttctatttaaacaaaaacaaaaacaaacaaacaaacaaacaaaaagctgggcatgatgcacacctttagtttcagctactaaggaggctgaggttggaggatcacttgagcctaggaggtcaacactgcagtgagctatgatcatgctactgccctccagcctgggcaacagagcaagaccctgtctccaaaaacataaataattaaatataaataaaaataaagcaaaatctgttgggaaacgagaaaaaggagaggaatttttcaggaataatcataaaaagaaatgatcatcagactgaaagtccagagcctgagaaatgaaaacatatttttaagcattggtgttgaccatgcagacaaacttttgttaattcagagcgatacaaaaggcactttgaatctataaaacttgaaaaagttaaaaattgtatgtcggataaagctttaagtcatctgtcactattaacctcagtgcagcaattctgactcctgtgcctggattccttttatgataattttgccacctacaggacagattaggtgctggtcgcctgaattattttgtgttctgaattattttgagctctaaaatggtaaagtacaaatactcattgttttactgtgcctttggccttttataaaaaggtatttataattcgttgataaaaaccaatatttgaagctgttgattaccaacaaaaaagtttcactctctttatagtgcttcaggatacaactttttcagggccttattagagaaaaactgattcacatgttattcttctaaagctaaattattaaaatgtaggttgaaagattggattgattgtgaatctacactaaagatatggttccaggcagacctccttagagacctccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttattaaaatatctactgtgtctattcttaaa

SEQ ID NO: 6833 - DNA, 1646 bp, Homo sapiens
gtgcgtgccgtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaag

SEQ ID NO: 6834 - DNA, 1047 bp, Homo sapiens
agcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaacatggtcccctctggggcgtccccagcctccccgtcctctgtctaacctcaccctctaa

SEQ ID NO: 6835 - DNA, 2071 bp, Homo sapiens
gttcatgtagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgtcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttgg

SEQ ID NO: 6836 - DNA, 3560 bp, Homo sapiens
gcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctccta

SEQ ID NO: 6837 - DNA, 4074 bp, Homo sapiens
cgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaaacacaagaaaatagagtgaggcttttttaccgtatatacataaaatacttatgaaaattagaagataatttggcattcctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaattgaagagattattttcctatgtaatttcacattctaatatactaaatgtttatattccttagagaactattttatattgtgcgctgggggcttgtgatgtttgtgtgctgttttaaaattcatttcaaattggactcgatttccttatatctaatatatatctgggagaaaaggctgcttgaaaatatcttttgattcagtgatttttaacattgggaagttgagtttattaaaaggtagtctg

SEQ ID NO: 6838 - DNA, 743 bp, Homo sapiens
cagttgcccggggtggcggtggcttgtcccgcctcggggtggttctgagggacccggagagagtttttccttctctatcccaaaacggttgtttgaatattgccgccggctcagtcattcggccgccggacttagctgttggttaaatgtccagaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatg

SEQ ID NO: 6839 - DNA, 4891 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtga

SEQ ID NO: 6840 - DNA, 1326 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgccgtctctactaaaaatacaaaaaattagctgggcatggttgcaggcgcctgtagtcccagctacttgggaggctgaggcaggagaatggcctgaacccgggaggcggagcttgcagtga

SEQ ID NO: 6841 - DNA, 4824 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtg

SEQ ID NO: 6842 - DNA, 5276 bp, Homo sapiens
acaaagggcccgcgcgcagccgccgccgccgccgccgcgcgaggagccaggatggtcctggtccacgtcggctatctcgtgcttccagtgtttggctctgtgcgaaacagaggtgccccctttcaaaggtctcagcatcctcacgctacctcctgccgccacttccacctgggccccccgcagccgcagcagctcgctcccgacttcccgctggcccaccccgtgcagtcgcagccaggcctcagcgcccacatggccccggcccaccagcacagcggcgccctgcaccagtcgctgaccccgctgcccaccctgcagttccaggacgtcacaggtccctccttcctacctcaggccctgcaccagcaatacctcctgcagcagcagctcctggaagcccagcaccgcaggctggtctcgcaccccaggcggagtcaggagcgtgtatctgtccacccccaccgcctccatcccagcttcgacttcggccaactgcagacacctcagcccaggtatttggctgagggcactgactgggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttcctggtctctggctgcttctctgactctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatat

SEQ ID NO: 6843 - DNA, 4391 bp, Homo sapiens
acaaagggcccgcgcgcagccgccgccgccgccgccgcgcgaggagccaggatggtcctggtccacgtcggctatctcgtgcttccagtgtttggctctgtgcgaaacagagggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttcctggtctctggctgcttctctgactctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgat

SEQ ID NO: 6844 - DNA, 7172 bp, Homo sapiens
acaaagggcccgcgcgcagccgccgccgccgccgccgcgcgaggagccaggatggtcctggtccacgtcggctatctcgtgcttccagtgtttggctctgtgcgaaacagagggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttcctggtctctggctgcttctctgactctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacccagccggtatcctctgaggaaagtcttggggcactagaggccactgtctccacctggcctccaactccagaattggagccctccagacattacaagaggaacatcagagagccaaaaagcctgacttcttagaaggagccctggactggggagccgggaggctcaggttttcaaatctgctccatgacagacgtcccaatgaccttgagcaagtcccttggcccctgagtctcagttttctgggtggggtgagtgaggagaactgggagatctttagggtcccttagattcaagtagaatgtgacacagatcccgtgggaaaccactgtgctgtgctgtctcaccttctgaggagagaagaaagagggagaaaaggcagggcatggtggctcacgcctgtaatcccagcactttgtgaggccaaggtgggcagatcacttgagatcaggagtttgagaccagcctggccaacatggtgaaaccctgtctctactaaaaatacaaaaattagctgggcgtggtggtaggcgtctgtaatcccagctactcgggaggctgaggcaggagaatggcttgaacccaggagacggaggttgcagtgagctgggagcgtgcaccactgcactctagcctgggtgataagaacaaaactcagtccaaaaaaaaaaaaaaaaaaaaagagggaaagagggagaaaggattgggaggagaaaaggagagcaaagaagaagagaagaatagagagagtgagctgagaatttgagcttgctcagagttgactttcgggagggtttttgtcctataatatgtggcatcctgtgggtgacagggaggtgagttaggtggacacgtataggacgtgccctttcataaggcttgggcagtcatttggcgagtgagctgaaatccatgtcttgttagagatagggatggggtaggcagaaaggagctccaaactatgggtttgggattggcacccctatcctatcatcacccagagtcttcattgttgagatgctgcccatggaaaacagattgggacatagattttggaatcaaggtctctgctcctggcatctcctctgtgcgtctccctctgcctttgctccctggggactgtgggcaggaggagcttcttcggaggaccgggagtgggcctccagtccccctgcccctgtagaggaataatgagggaggacatggggaagtcactgtcaaaggctggcacagctgtgagcccaatgcctctgagcgaaaaggagagagagggagttcacgcccctgagagtagccccctgagccggctgggacctggactgcctgctttcctcctgcctcttcccctttccctccttcacagcttatcctccttcttccctctttacatcactgcctttacctggtggggatgaggccccatggggaaggtgctgatgtggagggaggaagtggagaccgagattcgccatactgcccagggaggctgtgtgagaactgggctgtgtatggtccctaaagcctcaactctgccccagctgggcgatgggtgcccctctctgggcttcctgcctagcttccccttctgcctccagcctggagccttgctttccctggagacaagcccgtggagtcccccaccacactggagggagcacgaccaccacactgctgggcctggcagacaccacatctttggcagggctcctggacgggcatgccttatgctgctctgcagggtcagagtggaaaggggccctttgccctggctggcctgtgccctcacccttgagcccctccccccactccacccctggcctcggatgcggctaatttctcagccatggagccagctgcaccagccctcgagggggtaattttgttgcccctggcaagtgaaaggattatcctcagtgttgattgtccttttttgtaatcctcctgctgttctgttctgttgtgctgtgcaacattttgctacatagactattttatagcagaaagctagaagaatatttattatgaatattaaagcaatagtgcatcaatgaaaaggcggagacattaggaattgtgtaaatgcttagattcacttttggtggattttttgtactttatttataactaataaaaatgaactgcattgctaactaca

SEQ ID NO: 6845 - DNA, 1883 bp, Homo sapiens
ctacgatgacgtcagcgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatctcta

SEQ ID NO: 6846 - DNA, 1610 bp, Homo sapiens
ggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatctct

SEQ ID NO: 6847 - DNA, 2459 bp, Homo sapiens
actcccggctgctggctctctgaacaccaggctggcagtcactggaaactaggccgatagagcacccaccctgtgggtgcctcgttctgcctcctgctcctcgggcccagccgccctgccagtcgggctgggttccctcttgtgtctttcctgagtccttccggggaggacgaggctgtcttcctcccagccaaccttctgggcacctttcctctcttcccaagctctgcctgggacccttttccttcccctcagcccgtggccgtgctgtgcagccgagccccggcctggtctctggcagctcagggttcactcaggaggtgcaccatccagtcgtttccagtgtgtttgcaattatgcaacaatcgatgcaattctagaagattcttcccactccagaaagaaacccaggactctccccctcgcctggcacccacccgtctgctttctggtcactgggtttctctctgctggacgttgagcgtgagtggacccccacgacacgggtgggacgtgcttgctgtctgccctgcactgttttccaggccttccggtgcgtggtggggctgcacgcctcttcccggccgaacgccctttccatgggtgtgcacgccacgccgtctcttcatccgtttaccgacgggcacctgagctgcttccgcttctcctgccatgagtgcctgagtatgggggtcccctgaggcctccccaggtggaccatcttgccagcaccttcctcccgtgaacgggtgaagtaggcggcccccccggctcaaatccaggggtcagtgccagggatgaccctggaaatatctgctggggcgcctggttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatctct

SEQ ID NO: 6848 - DNA, 633 bp, Homo sapiens
agtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcac

SEQ ID NO: 6849 - DNA, 7823 bp, Homo sapiens
aacgggaaacaagatggcggctgcaggtccgagtactcgggcctcttccgcggcggcagcagccgctctgagtcggcggggccggcggggccgctgtgacgagacggcggcagctaagactggggccccaggcccggcttctggaccttcgctgttggtgttgtcgccgccgttgctgcagccgccgctgccgccgcggccggaggaatcgggctgcgccgggtgcctggagccccccggagaagcagcggccctgccgtgcggccactcgctttgccgaggctgcgcccaacgcgccgccgacgcggcgggcccgggttgccctcgctgccgcgcccgcggcccaggctgggcccgccgtcgggcccgcgacgacggccaggccgactcagaggtgctgggcgagtgcgcccgccgcagccaacccgagcgctgccgcccgcgccgggacgggggcgcggctgccgcggggcccaggccagagcaggagccgcgtgccgcgcctgcggagccagactttatattcagagcaccaatcaaattaagcaagcctggggaacttcgtgaggaatatgaaagcttgagaaagctgagagaagaaaagttacaagaggaaaaaccctctgaagatcaaatccacaagctgttaccagaggatacagaaacagggaaaaggaaaatggatgaacagaaaaaaagagatgaaccattagtactgaaaacaaatctggaacgttgtcctgcacgtctctcagattcagagaatgaagaaccttctcgaggccagatgacacagacacatcgctcggcatttgtttccaagaacaactcctactccttagctttcctggcagggaagctaaactccaaggtggaaaggagtcagagctgtagtgacacagcccaggaaagagcgaagagcagagtcagagcagttccaggcaacaaagccaaggtcacaactatgactccagcctccaaccccatcattggtgtcctcttgtcaactcaaaacaaccgctgcgtctcggcccctgacttaaccatcgaaaagcgtctacccttcagctccctttcatccttggcttccctgcataagccagagcgttctgtcagccctgagagcaatgacagcatctccgaagaactaaaccatttcaagcccattgtctgctcaccatgtactcctcccaagagactccctgatggccgtgtgctaagtcctctcatcatcaaatcaactccacgcaacctaaacagaagcctgcagaagcagacttcttatgaggccagtccacggatcctcaaaaagtgggaacagatctttcaggagcggcagatcaaaaagaccctttcaaaagccactcttacctctctggctcctgaaatgggggaagagttactaggctctgaaggtatccattctagcaaggagaagccacttgtggctgtaaatacaagattatctggtgggcaggtcctctctgagtatactggacccacctctgctgatcttgatcatttcccctctgttagccaaacaaaagcagaacaggacagtgataataaaagtagcactgagatcccactggaaacctgctgttcctcagaactcaaagggggaggcagtgggacttctttggagagggagcagtttgaggggttagggtcaactccagatgccaagttagacaaaacctgtataagcagagccatgaaaatcaccacagttaattcagtgctaccccaaaacagtgttttgggtggagtcctcaaaacaaagcaacaattgaagacattaaatcattttgatctgactaatggtgttctagttgagagcctaagtgaagagccacttccttctttgcgtcgaggccggaaaagacactgcaagaccaagcacttagaacaaaatggctcccttaaaaaactgcgacaaaccagtggggaggtgggtctggccccaacagacccagtcctgcgagagatggagcagaagcttcagcaagaggaagaagaccgacagttggctctgcagttgcagcgcatgttcgacaatgagaggcggactgtgagccggcgaaaaggaagtgtggatcagtatctcctacggtccagcaacatggccggggccaagtagcacctaatgaagtgttacctatttttaaaaggtcttaggccttgatcatttatcctgaagagctgagtgttctcactttggttttattttaatggcaaaacactgtctaatatggttctgagaggttccagggcctttgtagtcaatatccaagggaaaagcatctccgtttctctgtgacccaggccagaagcctgagtgacccatccctaagggcttctgggccaaacctggcagcacccactgggaatgagatttggaacggcctcaggagcataatggccacagttagtaatggtaaagaggggataccttcttaaactgatagacttcctgacttctttcagcagggtattgttttaaatcagccttgcagataaaaattaattccatctttttcagacaagtgaacaatttagttccttggcagatccaaaatgatagatggttatgttacgctttctgctgtcccttgccaaaaataagtaaatatatcagttaagattatgcctttacaaaagttaatttacattctctgtttaaaaaataatatttggtgaatgctatatagttgacagagcacatttacagaccttattaatttagtctttccaagagacctctcatgtaactggcattagccccatttttagatgatgaaactgcagtgcagatgttctggttctctcaactaccaagtggcataacccatggattttctaaaggtttcccaaatagatcacaacctaagggtgtgccaggggagcctaggggaagctaggctgggcattgaacactgatagtgcagaatccacatgcaaacaagatcgacagggtggataaacatatatgtgcattatccccatcccccacagtttagagccttctgcttttctgggggtttcagcctatgagacaaactataatcaggcttcattattacttttcaaatggccaagggttatctgcaatgttgatctaaaatcctaaaaaatcaccctgaagtcaggcaaggaacaatacttaaactccatactatggaaacaaggtatctagctggatgcagctggtaaattcagtcccatggacctttgggggtttattttccttagcagctgacaccatgtgtcttttgcatccctggtggtgcttggtgcttctgcccatctgggctcattgagaatagggatgaagatatgattttagggaatttctgatgggctggcatgccccatgtagtatgagttactatataaagtcatgtgactggcattttaacagaccttccagagcttatatatcccaatatatgttgtttcctttgagtagccccagcaggatactgcttagtttttccagtgccattggtgaaagcatttctggaactgtcttcaaagactagaaacactgactcccaaaatgctagaactggaagggaccttaatggttatctattccagcctcctcctaaggtcctcctcagcttctagacctagaagccaaagtccagaacagtgacccattgatcaaggcagatagtataactccttttaagtgttctcagatttgccttttctcagggcaaatcttcagtgttttgtggttatttgtggttgagagagagagagaatgtaatgtctgagactagccagcagctatttgaagcctctgggaaagaaggtggcttatcaagtgggtttgtagtaatgagtgctgctgtaaagcagagccattttcttgtgcagctcatagttcccaaacagttcccaaacagaaattccagagatgtcttaaacattgtggtcatcattgagataggtggaatctctttggtgactacgttggtggggaacatcactcacctgaatgtatgcattctgtgttctctgtgtgtgtgcacatatgcagatgtatgttttaaaaacatttaccaaactcatgattttgtagtcacaccacttcagttctgggccctaccaacaatttatgtcctccaagagctgctggagggcatgtttgtgcccaaaacagaagagctggctctggtttacagaagacagggagggtgaccttactataaatgcccttagaggaaacttatcagttactgccatttcacgcatttcctttttgatcttagtaaatattattggaaggctagtcttgttggtaggagcaaagacacttatttttccacttgccatctttctctatatctccagtaatttgaaaaacacttttcagttggaattgatttttgtctttggtaaaaagaaatatttttaatagataaaagatatatattttaaatatttccccaaattaatactttcattttaagaattgcatagcagttgtaacaagtgcagaatgaagaacaaattcttgttaagcaaatagtccaaactctaggtccagcttactgccttccccccttgtacctacagtgatgcctaggatggtattgacagttgttttctaaacttcctgctgagcaacagtccttcaaatataggtagagtggtctaggttaaggagggaggagggttgatctttaatcaggttggctttggaggaaggaaaaaccactaaggtattatctgaattttaagatgcttcccatccttaataactaaaacctgaatgcttttctttctgaaaaatctccctctctccttccatgattctgaagttggttaaaagtcgatatgttgatgtgtattatttgggggaacagaaaaggacaaggaaggaaacagaacgatgggaagggtttgtgagctagaataagaggtgcaggatttcacaaaacaaattcctcacaaatcattgaagcccagttcaccatacaaattacccatgtcttactctgttccttgtatatatgcattctgggtttttttattattaaaggggaagttaggggggagggtgaaggtcagtctgaggggaaatccaggaaatgtggtgcccttagaagggggctgtcagctcttttccatagagagggaaagaaactttgagaaaatgttcttgacccattgattgtatctgctggaagaagtcatctgggcctgttgggttggtatcagatcaggggattatgcatccagcccctggcccctttaatctatttgcctctttttaaaaaaggttaagtcttcttgggtgaggcttgccagggaaactcctaagtggcttcacttattttttaaattttaatttaatttttaaatttttgcttggaagcagcactggtaataaatgttttattttttgttcattttccctaaaggaaaaatgtccttaagagattaaagctcttaattgattactgtctggttacaaactggcaaactgactaaaatgggaagctgccaccgtgcctgactcatgtagctgatgaccgaaggctcatcctttcttttctatttgacagacatttactgagcttcagacttgagccaaccctgagctggactgtggagataaagcagttcctgctcttgaggagctcaatgtctaatggaatgcatttgaatgtatgtgtggctggagagttcatttatggtcttaggaaagccatttctggtcccatttagaaaactgaccagcacccagcaagctgcattctacattttagagaccccattggtatttgtgaatttgattgcaccaccgcttttcctttactaagtaatgttatggaaggagaatgaattttctcctctagtgattacaggacattaacatctcttcagaagctgcttttagcttaagccccaagaagtgaggtgggttgtggatcactgacatggtcaggggaggcccacacctcaattcagtaaccacctaatctctcccccaacctgatctctcatcagagctggcagcaacttgggattcctttcctttttcctgcctaacttttcattgaaatgtctagtaggagagtgagaaaagagaacaaaggctgggtcacagtcatagaatgttacagctggaatgggcatggaaatcatccaagttaaacttcttctctgccccccgcccccacttttttttttttttttttttaaccaaacgaacttgtgatccagtgccctattttatagtgtggttttccagggtctgaataaataatcattaaagtttgacacacgcagacacacgcaccaatgatggggatacccccaaatgatttaggaggttattttattttaatagttttttcttcctgatttttttcagttagttagagttaaatgtacctatagcccctgaatacatgctcaggtagagaaagtctccatagtataagtaagtaatatgaatgtggaatcttggaaagtgatatattttgattggaataattttaattaaatttaatgattttaattaagaattaaaagccagctagccaaattttctttaaaaattggaaactcattatggtcttaaattgtcctcaggcagccttttcctcatcaacccatagagtggtcttttgaactggtatctaaacatacctggttatgaattctcaaaagagaaagcaggtctggggcggggtggtcaggagacagattctagggaaagtgctgaagagattttcttctgaagatgatctaggaaatgcatctttatacatgattgttagctgctgtagctttctgaagaagattgtagaaaagagactaagatatatgcaagggtcaccagtttagagatcagtcaaattggaaaaagtgccaagactggatgtgcagattgttctatgtattatcagtatttttttcctcttaagaaaaaaatttactctctctcctttgtgagtaaatgcctccttaatgccttttaagtaaggtggcaacttttaactgtcatcttgtgagaggcaacctcaaactctaagcagactccctctctccctttctggtgtcttaaatcaagaactagtttgaagccaaggcaaagcaaggtttgttcatcttcctttcctgtcatttaaggtaaaacaggcaatgaactcgctcttcaaataccatagttcaagagtagctgttggccctggttccagattaatatagcagcaggcagattgccccttcttggggccaccaccctccaaagctgtgccaccaatgagagcattgggttcaagtttgcatcaaacatggtattaccaacgctgagcctccagcagagcacttaaaagtcctagtgagagaatagatactatgcaagggaaaaaaatttaaatgccaacgaatagtttttttttttttgaacctgatacactgtttgtttactctcaactctttgtacaaatattattgtcctaagggccttttcccctcctgcctagaaaataggttgtgtattggttttattcaacctgctgtctgctttaggattggagaaggtacctggatccttgtggactgccactgctggctgcctcctctccaactcatcagaagagcattttgacaaagacagaggacttggaccagggcatgccctgttggggatgtttctgtcagcaaggacatggcatggaatcaagtgggctgatgtgttgttatttaaacagtaccaaagtgcattcttcaatgtatgtttgcctgcttgaagcaaggcccaagttgagaatacagtaaaggaaactcatgaaagtgga

SEQ ID NO: 6850 - DNA, 340 bp, Homo sapiens
acttagaacaaaatggctcccttaaaaaactgcgacaaaccagtggggaggtgggtctggccccaacagacccagtcctgcgagagatggagcagaagcttcagcaagaggaagaagaccgacagttggctctgcagttgcagcgcatgttcgacaatgagaggcggactgtgagccggcgaaaaggaagtgtggatcagtatctcctacggtccagcaacatggccggggccaagtagcacctaatgaagtgttacctatttttaaaaggattggagaaggtacctggatccttgtggactgccactgctggctgcctcctctccaactcatcagaaga

SEQ ID NO: 6851 - DNA, 1830 bp, Homo sapiens
aaagcaaccaaagcttccagggtgtacaggaggtccaaagtcaccagaaggaagaagaaaacctgaaacagcgagagctggccaaacgctgctaagacctatgcaaataagacccacccacgctacctggaaatcgggcctgggaagtcagaaaacaaagcacatgcgtgcagggctgcacgaacggaggcggaggaggcggctccgagggagcagctgatcctgaaacagcagtggatccctgggagagcagcacagataaagatccaggcaataatgatgcttcctcctcttggacagccttttacagttctggccatggaacttcagagaaggtaggtctgatttggggggaaacaggagatcttgacgtgtagtaatacaagcttactggatggagtaaagttagaattttcaggtaagagaattaaaaaaaaaaaaaaaacttataatcttgcccccagagataaccactgctaatatctggttgtttatctctccagacattttttccattgcacacacacttttggaaattggattatatggtaatatggttttgttgctggttctttttcgcttaatgacattatatcctaggtatatatccatattaatagttttaccacatcatattaaaggctgcataatatctcttcctatggatggagcagaatctacttaatcaatgtcctattactggatgatgacgtagttctccatacgtcaccgttaaaccagcgcctggatgggcatctctttactcacatctttgcagaagtccttgatggtttccgtggaatcgattcccagtgggggaaatgatgagtcaaggttacatacagtttacggcctctgcagatcaactcttcaaattattcgaatgacccatatgagaaacagagaaaagccaagtatttctggttgaaacggagaagctgggctggagtgcgcctccctccaactccccgctttaactccctaaggttggtgggatggccagctctaagatctcagaaggctgaccagctgtgtgctaagaacaaagcagaaggcagcgaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattt

SEQ ID NO: 6852 - DNA, 849 bp, Homo sapiens
tggaaggggaagaggctctggaagggctgatctggggactggggcagggaagcttctgcaaggcttccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattttaaaaaaaaac

SEQ ID NO: 6853 - DNA, 1259 bp, Homo sapiens
ccccaccccccaggaagctctctggccttggctccaagcaggtgtgctcaagaggctgccgactgggccacctggcagccccaggtgctgcgtgcatgctgccatggagacaggcccctgggttggtggcaagaaggcagtctcccaaagctttgccgattcaggggagggagcaactggagcctcaggccctccagagtagtctgcctgaccaccctggagcccacagaagcccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattttaaaaaaaaacaaaaaaacgaaaagcttgaaggactgggagatgtggagcgacctccgggtgtgagtgtggcgtcatggaagggcagagaagcggttctgaccacagagctccacagcaagttgtgccaaagggctgcacagtggtatccaggaacctgactagcccaaatagcaagttgcatttctcactggagctgcttcaaaatcagtgcatatttttttgagttgctcttttactatgggttgctaaaaa

SEQ ID NO: 6854 - DNA, 2312 bp, Homo sapiens
cttcaaattattcgaatgacccatatgagaaacagagaaaagccaagtatttctggttgaaacggagaagctgggctggagtgcgcctccctccaactccccgctttaactccctaaggttggtgggatggccagctctaagatctcagaaggctgaccagctgtgtgctaagaacaaagcagaaggcagcgaggtttgtacacgctgattgcagttacttaggcacattaaaagatcagcgggtgactggactgaatctgatagtcggagctcttaagcttcgaagtaggtgactttcacagcaaccaaagtgctgagcaggcagcccctttgtgcaaggaggaggttccagccactttcgaagagaaatgagggccccagagagaggaagcccagaagactcagttaccctcttcacatctacaaagacgaaattgccaccctacctttccagaccagggactccaggtgttgaagggactgcccacaatctcacaggtgcttggcttccaggttcaattagttgccatgccctggggggaactcaggtcccccatcttcctccccaccccaccccccaggaagctctctggccttggctccaagcaggtgtgctcaagaggctgccgactgggccacctggcagccccaggtgctgcgtgcatgctgccatggagacaggcccctgggttggtggcaagaaggcagtctcccaaagctttgccgattcaggggagggagcaactggagcctcaggccctccagagtagtctgcctgaccaccctggagcccacagaagcccaggtgcgtgccctgaaggtttcccaggacaaagggagggaggaggagccagggtaggcagaggatggggaagaggctctggaaggggaagaggctctggaaggggaagaggctctggaagggctgatctggggactggggcagggaagcttctgcaaggcttccaggtaaggagaaaggcctttccaggggcttccttgccaggccaaggactgggtgagtaggatgtggagggttggccctctagctcaaggggaggagggaaagagggctggcatttgtccccataggagggacagaccagggaattcacaaaacccatctctgcgctagtcagggatttgaggtagcagggaaggaaacatttgtcctgtagcaaaacccgcagactgcagcttacccccagctccctggattcagggcagccaagggcacagacaatgaccataaggagcatttgcgtccagctccaaagcccagggcgacatctgctccaatgccggctctcttgggggctcttggtaggggtggcccaggccttcaccttgacagaggggaggctgtaggagcatttgactcaactcgatgggttaggaactggtgatcaagaacaaaacgcttttgaacctaagtaaaacgtggtgattacacctttcaacacccacagaacactttgccccaggccaagcacaaggatgggacttcatggctgttcctttgctcctttcccccttctgccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattt

SEQ ID NO: 6855 - DNA, 3924 bp, Homo sapiens
ggccggctactcctcggcagagcgaccgcgcggtgtctcagagcgcggcccggagccgcactaagagcgctggacggcgggagagaggctcggaggaccggtagctcccagcaaagcggcccagcggatgtcgggagctatcttcgggcccctggagggcccgagctccctggatgccccgagcatccacccgctggtgtgcccgctgtgccacgtgcagtacgagcgcccgtgtcttctggactgtttccacgacttctgtgccggctgcctgcgtggccgcgcgaccgacggccgcctcacctgcccgctgtgccaacaccagacggtgctgaagggtcccagcgggctcccgccggtggaccggctgctgcagttcctggtggacagctcaggggatggcgtggaggcggtgcgctgtgccaactgtgacctggagtgcagcgagcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcacgctgcacgcagagccctacctcttgttctccaccgacaagaagttgctgttgtgcatccgctgcttccgcgacatgcagaaggagagccgggcacactgcgtggacctggaatcggcttacgtgcagggctgcgagcggctggagcaggcggtgctggccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagttcctggacctgggctatgagctgatggagaggctgcagggcatcgtcacgcggccgcaccacctaaggcctattcagagcagcaagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaacccacgtgacgtaaaattttacaagtttttgtggcaaaatgatgcccagatagtcacatttaagcaaatattcagcttgattcagtgattaacagcaaatgggtctacgtgctaacatggcagcacattcaacacataacacatcactcacattgacgtccactgtccctgcacctgctacttcaggggcactgaggctcctgttccaaggccttacaaacctatgtggtggcctgcagggcaaaaggaattatcattacaactggttagaggtaggaattcagaaagaaattgaggaggccaaacacacgtcgtttgaggctaaaggcttaagacgcttcttacccaagagtgacctcagagtttcacatcccagacaatcacactgtggttgagtgaaatcaagtgcagttttatttaagaactggaaagaataatcagtatctgtgaaagaaaatccaatttagaatatttaaataaacatttatgtaaaaagaa

SEQ ID NO: 6856 - DNA, 3796 bp, Homo sapiens
cccgcgcagagtgggaaccatcgcccggtgcgggcctgaacttccagggccggctactcctcggcagagcgaccgcgcggtgtctcagagcgcggcccggagccgcactaagagcgctggacggcgggagagaggctcggaggaccggtagctcccagcaaagcggcccagcggatgtcgggagctatcttcgggcccctggagggcccgagctccctggatgccccgagcatccacccgctggtgtgcccgctgtgccacgtgcagtacgagcgcccgtgtcttctggactgtttccacgacttctgtgccggctgcctgcgtggccgcgcgaccgacggccgcctcacctgcccgctgtgccaacaccagacggtgctgaagggtcccagcgggctcccgccggtggaccggctgctgcagttcctggtggacagctcaggggatggcgtggaggcggtgcgctgtgccaactgtgacctggagtgcagcgagcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcacgctgcacgcagagccctacctcttgttctccaccgacaagaagttgctgttgtgcatccgctgcttccgcgacatgcagaaggagagccgggcacactgcgtggacctggaatcggcttacgtgcagggctgcgagcggctggagcaggcggtgctggccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagttcctggacctgggctatgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaacccacgtgacgtaaaattttacaagtttttgtggcaaaatgatgcccagatagtcacatttaagcaaatattcagcttgattcagtgattaacagcaaatgggtctacgtgctaacatggcagcacattcaacacataacacatcactcacattgacgtccactgtccctgcacctgctacttcaggggcactgaggctcctgttccaaggccttacaaacctatgtggtggcctgcagggcaaaaggaattatcattacaactggttagaggtaggaattcagaaagaaattgaggaggccaaacacacgtcgtttgaggctaaaggcttaagacgcttcttacccaagagtgacctcagagtttcacatcccagacaatcacactgtggttgagtgaaatcaagtgcagttttatttaagaactggaaagaataatcagtatctgtgaaagaaaatccaatttagaatatttaaataaacatttatgt

SEQ ID NO: 6857 - DNA, 1069 bp, Homo sapiens
cggggccccccccaggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctgagctaccggctgccccctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagttt

SEQ ID NO: 6858 - DNA, 1127 bp, Homo sapiens
ggcctgctgacctcggctgcagggggagccccccccgcgccccctcgccagcctcagcagccagagaccctgggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctgagctaccggctgccccctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagttt

SEQ ID NO: 6859 - DNA, 2646 bp, Homo sapiens
cagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccaggaattgctctgaagagaaatccccacaaacctccatcctaaaggaaggtaacagggacacaagcttggatttccgacctgtagtgtctccagcaaatggggttgaaggagtccgagtggatcaggatgatgatcaagatagctcttccctgaagctttctcagaacattgctgtacagactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataaggcccagatgaccaacattcttcagcagatcaagacagcacgtaccaccatggcaggcctgaccatggaggaacttatccagttggttgctgcacgactggcagaacatgagcgggtggcagcaagtactcagccacttggtcgcatccgggccttgttccctgctccactggcccaaatcagtaccccaatgttcttgccttctgcccaagtttcatatcctggaaggtcttcacatgctccagccacctgtaagctatgtctaatgtgccagaaactcgtccagcccagtgagctgcatccaatggcgtgtacccatgtattgcacaaggagtgtatcaaattctgggcccagaccaacacaaatgacacttgtcccttttgtccaactcttaaatgacggacctgactggggaggaagaagaagagaaactgatgtgaacaggaagcgcgggttcaagatttctaaaactctatatttatacagtgacatatactcatgccatgtacatttttattatataggtaatgtgtgtatagaaagtctgtattccaatgttcgtaaatgaaactatgtatattatgcagaaacagtctgttccccctcatcttgcaattcctttgggggatgcagattgtagggaagatgatgtttagtttggccttgaaattatgatatccctgcccagggctgttttcaaatacaatataaaaaccacctaggaacctgctgttgctctaaggccattctgctttggtttggctcagcctctagtccatttccttaaggctcatgtatgcagatttaaagcctggtgctcacccactgtccaaccagatgccttgcttaccgaaagcctccagaagcctcagtattgttttagccactctactccaaatggataaaatgagactctgattgagg

SEQ ID NO: 6860 - DNA, 2695 bp, Homo sapiens
gtccctcccccactttcctcccgggggcgcggcgcgggagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccaggaattgctctgaagagaaatccccacaaacctccatcctaaaggaaggtaacagggacacaagcttggatttccgacctgtagtgtctccagcaaatggggttgaaggagtccgagtggatcaggatgatgatcaagatagctcttccctgaagctttctcagaacattgctgtacagactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataaggcccagatgaccaacattcttcagcagatcaagacagcacgtaccaccatggcaggcctgaccatggaggaacttatccagttggttgctgcacgactggcagaacatgagcgggtggcagcaagtactcagccacttggtcgcatccgggccttgttccctgctccactggcccaaatcagtaccccaatgttcttgccttctgcccaagtttcatatcctggaaggtcttcacatgctccagccacctgtaagctatgtctaatgtgccagaaactcgtccagcccagtgagctgcatccaatggcgtgtacccatgtattgcacaaggagtgtatcaaattctgggcccagaccaacacaaatgacacttgtcccttttgtccaactcttaaatgacggacctgactggggaggaagaagaagagaaactgatgtgaacaggaagcgcgggttcaagatttctaaaactctatatttatacagtgacatatactcatgccatgtacatttttattatataggtaatgtgtgtatagaaagtctgtattccaatgttcgtaaatgaaactatgtatattatgcagaaacagtctgttccccctcatcttgcaattcctttgggggatgcagattgtagggaagatgatgtttagtttggccttgaaattatgatatccctgcccagggctgttttcaaatacaatataaaaaccacctaggaacctgctgttgctctaaggccattctgctttggtttggctcagcctctagtccatttccttaaggctcatgtatgcagatttaaagcctggtgctcacccactgtccaaccagatgccttgcttaccgaaagcctccagaagcctcagtattgttttagccactctactccaaatggataaaatgagactctgattgaggaaaaaaaagtaa

SEQ ID NO: 6861 - DNA, 548 bp, Homo sapiens
ctccgctcgtgccgccggaagtgggaggtgccgcgcgcgggccggcgctcgacccctccccccgtggctcggccgccccctccccccgctccgcccgctcagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccag

SEQ ID NO: 6862 - DNA, 3529 bp, Homo sapiens
ggcgaagagtagcggtaggtcggcgggacttccgtgttggcgggattctgaacgctgccatggctcagaccgtgcagaatgttacattgtcgctcactctgcccatcacgtgccacatttgcttggggaaggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggcaaataaaaaattgaaattggaaaatggtggtctggtgagggagaatttacgactgaaggctgaagttgataacagatcacctcaaaagtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtcccttagttgccttcagctcagtactccagaaaatagagagagctctgtggtccaagcaggaggttccaaaaagcactcaaaccatctcagaaaattggtgtttgatgatttttgtgattcttcaaatgtttctaataaagattcttcagaagatgatataagtagaagtgaaaatgaaaagaaatcagaatgtttttcttccccaaagacaggattttgggactgttgttccacaagctatgcccaaaacttagattttgaaagttcagaggggaacacgatagcaaattctgttggagaaatatcttcaaaattgagtgagaaatcaggcttatgtttatccaaaaggttgaattctattcgctcttttgaaatgaaccggacaagaacatccagtgaagcatcgatggatgctgcttaccttgacaaaatctctgagttggattcaatgatgtcagagtcagacaacagcaagagcccttgtaataacggttttaagtcactggatttggatgggttatcaaagtcatctcaaggcagtgaatttcttgaggaacctgataagttggaagaaaaaactgagctaaacctttccaaaggttctctaactaatgatcagttagaaaatggaagtgaatggaaacccacttctttttttctcctctctccatctgaccaagaaatgaatgaagatttttcactccattccagttcttgtccagtaactaatgaaatcaaacccccaagctgcttgtttcagacagagttttcccagggcattttgttaagcagttcacatcgactatttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactg

SEQ ID NO: 6863 - DNA, 2786 bp, Homo sapiens
cagctgagcgtgccatctcccagtggccatgtcagaaggggagagcaaggacagctcgggcagtgagtgccccgtgtgctatgagaagttccgggacctggagggcgccagccggacgctgagctgtggccatgtgttctgccatgactgcctggtcaagtacctgctgtccacccgcgtggatgggcaggtccagaggaccctggtctgccccatctgccgctacgtcacattcctcagcaagaagagctcccgctggccctccatgctggacaagagctcccagacgctggctgtgcccgtgggcctgccctccgtgcccccactggacagcctgggccacacaaaccccctggccgcctcctcccctgcctggaggccacctccaggccaggccaggccgccaggcagcccgggccagagcgcccagctccccctggacctgctgcccagcctgccccgggagtcacagatctttgtcatcagccgccacgggatgcccctgggggagcaggacagcgtgctgccccgccgcagcctggcagagctctcggaggcctccctggcgccccgctccgcccgcgccttctgctgccgatcgcgggccctgctgctcatcacgctcatcgctgtggtggccgtggtggccgccatcctgccctgggtgctgctggtgaggaagcaggcgtgagccgcacctcagggaggccgccgggctagccgtggcctggggtgggacaggaggcccacggcagccctggtgccaccaagctccgaggggcacgcgggcaggcagaggggaggacctgggcacagagagggccttgggcttccccgacccccgcaggggcttccgctcgacagagaggctggagctgactccatgcgcgcggcgcgtgttccccacgtgaatcctcagcagatgcgttccccttcctctaggctgggaagatgggtggtcactgccctcctgcaggctcaccagccctgagcggcagaccttacctgccaggtgacctgcccaaagccaggtgggcccctccagggacaagaaagtcctgcaggcagacgtcctgctgggctggccgatggcaggatcctccaggccagaattcccacccaggatttgcggcttgccctcgggaacagacagaaggggcgcccagaatctcagcactcacccccgacctccaccacagcaccccatcccctaaccctccctgtccccaacctgccagcttagaagggcttccctgaaggagaagctgatctcagaggctgccccagaatttctgggagaatgaacagaaactgttcttcctgcagagctgaggccagatccagagacaggggttggttgatagaggccaccccagcagagtgccccacgaacggagccagaggtctccctgagccctccaggccaaaggagggatccaaactttgagtcctggggttctcaagggtggcagggagtggaggggaagcctgacaggcgagccttgagtcagctgagaactatgtgggcaaacgaacccctgggggctcccgcctccctcccagctagtcctcctcctcatgacccagccactcatttagaggccacaccagctgggccagtttcctaggtggattgccaggctgggctgggtgaggaagggtggggaggaaaacagctgtgcttgtcagggacgccgccatctcaaccgagaaatgctgaggcccaggtgccctcagctgctcctcaaggtctctttgcctggggcccccacgttggactgtgaagagcctcaggttgggtctagcctgagtcattcggggatagctattggctgtttattgaggtccgtaagtcaaccaacacctttcaatggaaaacaacaaaaacctccagcaattatctcaactaagtggtggtctgcacccagctgtgcccacagctgagcccccaacctccctcaacctatacccctctgggcaatttgctgtcttggtggggagggaagaaatagcagtctacgttttatctagttcctaaatgcctgcagtgctggtcatttggggaccgctggggaattgggccccactacaggggatatttgggacatagagagggctgctttaaaagcacttgtgggcttctctgtgctcatttcaagattacagaagtggccaggcacggtggctcatgtctgtaatcccagcactttgggaggccgaggtgggtggatcacaaggtcaggagttcgagaccagcctggccaatatggtgaaaccgcgtctctactaaaaatacaaaaattagccaggagtggtggcacgtgcctgtaatcccagctacctgggagagacagaagattcgcttgaacccgggaggcggaggttgcagtgagccgagatcgcgccactgcactccagcctgggtgacagagcgagactctgtctaaaaaaaaaaaaaaattacagaagagcacaggtgctattggaggggagggatacagatggattccatggggaaaatatttattataggaataaaaataatgttaaatttgcaaagactccaatgagtctcttttaacctcagccaggctgttttaaacagtgtcatgaatttctgggaacctggttctagtcttttcagattctgtcgtatttgccaaaagtttctttcaacatactctcagtgtttttgtatgttcaatggtgacctgtagctgcaactccttttattgtcagagaatgccaaaagctatttttaaaataaaggtatatattttctcaaa

SEQ ID NO: 6864 - DNA, 3063 bp, Homo sapiens
tcattaggaattgcctcggcggtggcggtcacactaacagcaacaggaggagatcgtgctgctgctcagcacctcggggtggctcagatctgctggaggccccaggagggaaggtggatgctgctctctccggacttggctaccagtgacttctgggcatttccaaagtatcagacatattctcaaaggatgaaattctgtctccatcacggttaatcagatgcttctctcactgcctcaggcagccccataagaagaatttggagaatgactgagctgtggcagctgagcgtgccatctcccagtggccatgtcagaaggggagagcaaggacagctcgggcagtgagtgccccgtgtgctatgagaagttccgggacctggagggcgccagccggacgctgagctgtggccatgtgttctgccatgactgcctggtcaagtacctgctgtccacccgcgtggatgggcaggtccagaggaccctggtctgccccatctgccgctacgtcacattcctcagcaagaagagctcccgctggccctccatgctggacaagagctcccagacgctggctgtgcccgtgggcctgccctccgtgcccccactggacagcctgggccacacaaaccccctggccgcctcctcccctgcctggaggccacctccaggccaggccaggccgccaggcagcccgggccagagcgcccagctccccctggacctgctgcccagcctgccccgggagtcacagatctttgtcatcagccgccacgggatgcccctgggggagcaggacagcgtgctgccccgccgcagcctggcagagctctcggaggcctccctggcgccccgctccgcccgcgccttctgctgccgatcgcgggccctgctgctcatcacgctcatcgctgtggtggccgtggtggccgccatcctgccctgggtgctgctggtgaggaagcaggcgtgagccgcacctcagggaggccgccgggctagccgtggcctggggtgggacaggaggcccacggcagccctggtgccaccaagctccgaggggcacgcgggcaggcagaggggaggacctgggcacagagagggccttgggcttccccgacccccgcaggggcttccgctcgacagagaggctggagctgactccatgcgcgcggcgcgtgttccccacgtgaatcctcagcagatgcgttccccttcctctaggctgggaagatgggtggtcactgccctcctgcaggctcaccagccctgagcggcagaccttacctgccaggtgacctgcccaaagccaggtgggcccctccagggacaagaaagtcctgcaggcagacgtcctgctgggctggccgatggcaggatcctccaggccagaattcccacccaggatttgcggcttgccctcgggaacagacagaaggggcgcccagaatctcagcactcacccccgacctccaccacagcaccccatcccctaaccctccctgtccccaacctgccagcttagaagggcttccctgaaggagaagctgatctcagaggctgccccagaatttctgggagaatgaacagaaactgttcttcctgcagagctgaggccagatccagagacaggggttggttgatagaggccaccccagcagagtgccccacgaacggagccagaggtctccctgagccctccaggccaaaggagggatccaaactttgagtcctggggttctcaagggtggcagggagtggaggggaagcctgacaggcgagccttgagtcagctgagaactatgtgggcaaacgaacccctgggggctcccgcctccctcccagctagtcctcctcctcatgacccagccactcatttagaggccacaccagctgggccagtttcctaggtggattgccaggctgggctgggtgaggaagggtggggaggaaaacagctgtgcttgtcagggacgccgccatctcaaccgagaaatgctgaggcccaggtgccctcagctgctcctcaaggtctctttgcctggggcccccacgttggactgtgaagagcctcaggttgggtctagcctgagtcattcggggatagctattggctgtttattgaggtccgtaagtcaaccaacacctttcaatggaaaacaacaaaaacctccagcaattatctcaactaagtggtggtctgcacccagctgtgcccacagctgagcccccaacctccctcaacctatacccctctgggcaatttgctgtcttggtggggagggaagaaatagcagtctacgttttatctagttcctaaatgcctgcagtgctggtcatttggggaccgctggggaattgggccccactacaggggatatttgggacatagagagggctgctttaaaagcacttgtgggcttctctgtgctcatttcaagattacagaagtggccaggcacggtggctcatgtctgtaatcccagcactttgggaggccgaggtgggtggatcacaaggtcaggagttcgagaccagcctggccaatatggtgaaaccgcgtctctactaaaaatacaaaaattagccaggagtggtggcacgtgcctgtaatcccagctacctgggagagacagaagattcgcttgaacccgggaggcggaggttgcagtgagccgagatcgcgccactgcactccagcctgggtgacagagcgagactctgtctaaaaaaaaaaaaaaattacagaagagcacaggtgctattggaggggagggatacagatggattccatggggaaaatatttattataggaataaaaataatgttaaatttgcaaagactccaatgagtctcttttaacctcagccaggctgttttaaacagtgtcatgaatttctgggaacctggttctagtcttttcagattctgtcgtatttgccaaaagtttctttcaacatactctcagtgtttttgtatgttcaatggtgacctgtagctgcaactccttttattgtcagagaatgccaaaagctatttttaaaataaaggtatatattttc

SEQ ID NO: 6865 - DNA, 1503 bp, Homo sapiens
cagggtggcctggaggctgcagacgggcagagcagccaggagctgcccaccaaggaggcgtctggcactgtctggggtcccgagctgggagcggggatccccagacacggagctggtgcgccacctggagtccatgtggactggtgcagccctctgccgtccagccggcatcaaggtgaggctgagaagccacacagatccacagacaagcacagtggcaaagtctgcagaaggctctgagccaggagggaaccctggcaggcttcctagaggaggagatgtgagcagaggccaagatctagtttcaaggctttgtggctgaaacgggagcccacgcccgccacagctggccacctgcctctctcctgactcccgtgcaaggccagtaatgcaacccaggagggagccgcagggcgccctgggtcccccactcccttctccggccaccccgtggctgtgcatagctgcccagcagagcccatgcaggatgctgcagccggagggcccccaggcctcggaggaggggggcccccggaggagaggacagactgcatcatctgctgctcggcctatgacctctccgggcacctgccccgccgcctctactgtggacacaccttctgccaggcgtgtgtgcggcggctggacacaccggcgcccgagcagcgctggatcccctgtccgcagtgccgtcagagcacgcccacgcctcgcggaggggtggccatgctagacctggacctggctgctttcctggcggtcaaggctgagcgggagccggcaagactagaacccctgcccctcacctccctcaaaggcagcgccatcactcggcagccagctgggctgtgccctgccctgggaccccagccccacttcccccagcccagatactgctgctggggctgtggcagcctctgctgcccacccctaggcagccccgaggtctgaactctggccattcccacccctgcaggggaaatgcctgccttggaacccctgaccacacaccatcatgggttcagcccactcagaacaacctggcagtagcatcctatacgcagcttcgtgtggcccagcagggtggtgtcatcccagccgtgaacatcccaggccacagcctaaggttgggggctgggaggctccgcaggaggctggtgacctcccacctgtcctggccacaattaccagaccccagactagcccgaccggatgtgcctggtgaggacactgctgtctgagtgggcggcaagcctggcttgggcctagacgcagcgcaaaggatggctcccaagaggatgcgaaggcgtcccgggggcctgggctgcaggctggaggggcagggccggtctggctatgcctggcgggctgcccagagcaggtctcccctctcccacagacgtccccggggtgtaccgggagggtggcaagactacctccttcctccctgccctgcatggcagccctgtgaattcacccactcaacaaagctcatggagttcc

SEQ ID NO: 6866 - DNA, 3270 bp, Homo sapiens
tctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaa

SEQ ID NO: 6867 - DNA, 2452 bp, Homo sapiens
acgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacagaccagcttttgatacagccatgcactctgcattttgatgtgaaagctgccaccttcaataggtcatttctctgccagccttgccagaccagagtcagttgtatcatcctggggcaagtatgaggagaagctcacgattaccaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaa

SEQ ID NO: 6868 - DNA, 1278 bp, Homo sapiens
gcgtagcagcggtgggcggggcaaaggatccgtctgaggcggcgacgagtgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttata

SEQ ID NO: 6869 - DNA, 890 bp, Homo sapiens
gatgtcccaggggtattggggcggggggttgaaataactggggttcaggaggagggatggtggtagagataaaaatgtgagaagggagcagcactggcgaggagtcgggagagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctgg

SEQ ID NO: 6870 - DNA, 582 bp, Homo sapiens
gtctgaggcggcgacgagtggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatga

SEQ ID NO: 6871 - DNA, 716 bp, Homo sapiens
ccggcaccagggcagtactgtggccgctgcggcctcagctccgactgggtcaggttgcggagactccaggccgcttccagggcggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgagtg

SEQ ID NO: 6872 - DNA, 1193 bp, Homo sapiens
gcaaaggatccgtctgaggcggcgacgagtgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataa

SEQ ID NO: 6873 - DNA, 4155 bp, Homo sapiens
gcggggcggggcccctgcgggcttgcagcgggctactgtttgccggagcctcccggcgcgcccccgcgagccccctcccgtctggcgcgcgaccccgccgcttcgaatgttgtgaatcaaatgtggggtttgttacattccgctgccgccgcggacagttcttaaagggccagccgccggctgccgcgcagacccagctgcgtcctgcgccgcctcccgctccctgagggcctgggccgagagagactgatcgcgcgtgggcctcgcgaggcagacgccgtcgggcggacaacaaagagagaggccccggaaggagccgggctgcccccggacccgggggtggggaggggagcacattgttccgcagggcgggagctcttaaaggatccagacaggcaccccccccctcccccgccccctgcccagtttggccgtcctagatcgggaacaaaggagtcaacgtgtggccgggcggccaaagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcccctccagcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtataccaacgaccgcccacgctg

SEQ ID NO: 6874 - DNA, 1647 bp, Homo sapiens
agacgttagctcgtttgcatgggtggtccgccattggtctgttgggcaatctgggccgtaccagctttttaaagacgccgtgtagtataaacaaggagaagtggggcggccgggccatgatgtcagcgcggtgctgcagctcttgggggtgacgtcatctccgggaaggtggccggcccagggttgttagagccagcataaccacttgggccgctctcgccccgtcagaggtcagacccattgcacttcagtatctcaggcggcaccctgtccccgaggaggggaccatgacacaggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcccctccagcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggag

SEQ ID NO: 6875 - DNA, 2810 bp, Homo sapiens
agcgaccctactgtgggtgcggtgtcttcccagagagtggtgaagttaggaaggtacgaccccctaggccgaacagcctgtgggctagctggcgcctcctgccgcagtaaacacaaagtggggtacagaaacgaaaactccgggaagaaacggccagcacgggcctcgccgtgccggctactcaacacgccttcctgagagcacagaacatccacagccctatacagcgcgccatccagagagctccggactcccagctcggcgcaggggcgggacttccgctcaagtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgacgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaa

SEQ ID NO: 6876 - DNA, 3922 bp, Homo sapiens
ggaataacgacctgccttacgctttgcggctgtcgtcggagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaactgtccagggctatcggttgacaaatgcaggatatgattacctagctttgaaaacactttcttctaggcaagtagttgagtctgttggaaaccagatgggtgttggcaaagaatcagatatttacattgttgcaaatgaagaaggacaacaatttgcattaaagcttcacagactaggaagaacctcgtttcgaaatttgaaaaacaaacgcgattatcataaacataggcacaatgtgtcatggctatatttatctcgtctctctgccatgaaggaatttgcctatatgaaggcattgtatgagaggaaatttccagttccaaagccaattgattacaatcgtcatgcagtggtcatggaactcataaatggttatccactatgtcagatacaccatgttgaagatcctgcatcagtatatgatgaagctatggaactaattgtcaaacttgcaaatcatgggctgattcatggagattttaatgaatttaatctcattttggatgaaagtgaccatatcaccatgattgattttccacagatggtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacgggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcagagatgaagaaaatgtgggagctatgaatcagtatagaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagccagcttttggggagaataatatatttaggatcttggatatgtttaatatattttttaaagttactgtaattcctttttgagccctcatttgtcttttttgagccaaggctatcatatattaataaataaaccctctttcatctataaatttggtcattcagtatgtgtcttgcaaagaataattacctgccaaagcagtccatttttttcaaagtaatttgggtaactacagttacgtaactttattagagacatttgcatatttttaaaaatctaaataacatttttgttgttttctgtttgttgaggatgatatgctacaatgcacataaagcaattagaacaatgtttagcacattcttaagcattcaataaaacatggctattagaatcataatgattctgaaattctgctgacaatttggttgcattttatttggcaactggaggacttcactgtcttatttttctttagaagtaaagataagcctttggaagtaaagataagccagtgatgcacaatttgcttaattaattgattaataatctgttttgtgccacttacattggtaatgtggtcatgagaatggaaacttacttgagatagtctaccacaatttttacagttggcagcttgtaagcaggcctgagtagcagaagagttaggggttggggaaggtggagtagaatgaggaatgaaatgttctttctcatatgcttattatataagtgggtccggaacatgttctcacctcaaggttaacaaatacctaatgcaggaaagaaaatacatagccatggtcccttcctcaaggactttataattcagtgagatgtaaagatgagtgcttaagtgtatgcacctgattattgtctcttcattgccgcataagtcggaaaaggggatcacttgcagcgaaaaatggccactagatggcaatatcaccccatagtcaccaaacaggattacttgcatccctaattatgttctaccagagggaatatagtacagacttttccaagattgataaagacagcagattccctttcacctttgccaaattaactctactagctatttgcaagacctgtaattatctaataaattggcttaaatatatagaagctagaaaatgccaattcctcttccctcaaaagttacctgacattcaaatatttaaatacccttgctttgcattttagatatatctttgaattcaggtattcattttgtataatctctcaacttttaagcatttttataatgtaaagttgaaaacagcttaatagaaccacagaatgtttattttggagtcattttcttatattcagagctatgaaagcaaattgggaataaagccttatcctgctcagctttacctagttgactcagttgacttttgagtatctactacataaaaagcccattactattaagaaactcaagacaaacatgatttttacctttaatagcctaagatttcttgtgggccaaggaattaattattccaatcagaaatggaggccttacctcatttgggcaaagattagtgctagttattgaagatttactaataaatgatctgttaaggaatttagttttttttggatatgttgttttggttgttgaaaactaaggtataattataatagttattttttgaagatatgtttggctagccatcaattagaagttagagagtttgtcctaacagataagctataaccctcacattttaaaacatgcatagtgaacaatgaacaaaaacaaattcaaaattttactaatgtaaagctgtatattgtgattgttaaaacacttttttttgcctaggagttccagatttaaatcctggttctacacttcccaaacctcaggtaccttctgtggcctctctaacctcaatttttttacttgtaaaatggggacatttaatagtatacctcagtgtcgtgaagactaaatgaagtaccacttgtaaagagtttattacagtgcctgacatatactgtatggttagtactgctaaaatgacttcttaaggttaccaaaaggaaaattccacaagctgaccacctttcctattgtgatggtcactggtatttcagctatgatcctttgttgtgtatttatccagactgaaagatgtttttctagtaaccatcttgcatcgtcttagtctccccattaaataaacttttcctacaaacta

SEQ ID NO: 6877 - DNA, 2149 bp, Homo sapiens
gagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaactgtccagggctatcggttgacaaatgcaggatatgattacctagctttgaaaacactttcttctaggcaagtagttgagtctgttggaaaccagatgggtgttggcaaagaatcagatatttacattgttgcaaatgaagaaggacaacaatttgcattaaagcttcacagactaggaagaacctcgtttcgaaatttgaaaaacaaacgcgattatcataaacataggcacaatgtgtcatggctatatttatctcgtctctctgccatgaaggaatttgcctatatgaaggcattgtatgagaggaaatttccagttccaaagccaattgattacaatcgtcatgcagtggtcatggaactcataaatggttatccactatgtcagatacaccatgttgaagatcctgcatcagtatatgatgaagctatggaactaattgtcaaacttgcaaatcatgggctgattcatggagattttaatgaatttaatctcattttggatgaaagtgaccatatcaccatgattgattttccacagatggtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacgggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcaggtatagacttctgtcgattgctttttaactttagtcttgagactgatactttgttagattctagtaaaagaatgtttttttcaaatgatgtgacaaaattgtattctgccaccttgatgtataaaatgaaagccaaataattttttgttgttaaaaactcaaaatagcttccttttcaattgacctgattctaggcagcctattgactaaatttcaagtaattctgccttaaaatacaaactgatggctgggcacagtggctcgctcatgcctgtaatctcagcacttctgggaggccaaggcaggcaaatcacctgaggtcaggagtttgagaccagccaggccaacatggcaaaaccctgtctctactaaaaatataaaaattaaccgggcatggtggcctgtgcttgtaatcccagctacttgggagactgaggcaggagaatcacttgaacctgggaggcagaggttgcagtaagccaaagatcgtaccactgcactccagcctgggtgacgagcaaaaaactccgtctcaaaaatatatatatatatacaaactgatgattttaaaattattgcaggtctctggatacattgatcaggttttagatggatgagttattcctcatatattttcctaattacacatctgatgtgtgtttgagttatgtaaaggcatgtaaatattaaaacatgcaataaatgtactttctatatgaaa

SEQ ID NO: 6878 - DNA, 4038 bp, Homo sapiens
aacaacaaccaccacaaactccgaccgtcctttccaggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaaattg

SEQ ID NO: 6879 - DNA, 1553 bp, Homo sapiens
ggggaaggggcgttttccagccccgaaggagtcctttggggttggaggaggggcgcgagcgcgcggcaaatcgggcgggaagaggtaaaaaaggaactgggagcgcgccgcggcggttcctgtccttacagttgcgctgcccagggaccgatgttgcgcgaggaaaatgcgggacgcccagggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaa

SEQ ID NO: 6880 - DNA, 3694 bp, Homo sapiens
gtttgctggctgggagcctagaagggatagtgggcgaggctccgccccgtggtggggcgctttccgtcggcgtgtgttttggggttgccatcggcccgtagtatgtgaaaagtgagtttgcaaagaatcagtgggaaatctgtactctaaagggccggaaagcgtgttatggccctgccacttcgtggctagagaccgtgggctttacctctttaaagctgccttacctcatttttcctgcaaagggctgacgtcgctgaactctctgaaatgtagagagcccgaggggaagttgctgcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcacaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaa

SEQ ID NO: 6881 - DNA, 1638 bp, Homo sapiens
aactaccgcccctgcctctgggaattgaagtttctgtggaaggaagcgtgagccgtaaccaggccaacccagaaaggctttctttctgagatttcacttccctgtcaactcttcagctcgttgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaat

SEQ ID NO: 6882 - DNA, 3516 bp, Homo sapiens
ctctgggaattgaagtttctgtggaaggaagcgtgagccgtaaccaggccaacccagaaaggctttctttctgagatttcacttccctgtcaactcttcagctcgaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcacaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaata

SEQ ID NO: 6883 - DNA, 802 bp, Homo sapiens
ccgcggcctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaaaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattgg

SEQ ID NO: 6884 - DNA, 788 bp, Homo sapiens
ctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaattgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatc

SEQ ID NO: 6885 - DNA, 2281 bp, Homo sapiens
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaacccgggcggcggaggttgtagtgagccaagatccagcctgggcgacagagccagactcttgtctcgaggggaaaaaaaaaaaaaattatgtaacaaggaattagcctcaaaaccacatggctttggacgtgctaattcaacttttgtacatctatttgtgagagacctcttgaaattgtttaaatggttacatcaagagtttaatattcactaaactggcatcataaaattgtatgactttctccagccttgtctgatcatgctcgttgttgcccagctcagtaataagctttgcaggatccagcctgttctgacctatccctactgagtccccatagcattttgttccctcctgtggctcttaccttgttctcccttgcagagtatgggcatggagggcttctcttcctaatccttcctaatggtaggatcctaacaggacaaatctgtgtacctatctttctatcctccctgagcctgtaccaactagattcttcatatgtatttgtaacagattaaattggaaagcaaacaca

SEQ ID NO: 6886 - DNA, 1494 bp, Homo sapiens
ggatccgatgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaa

SEQ ID NO: 6887 - DNA, 1045 bp, Homo sapiens
gatgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaagttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcag

SEQ ID NO: 6888 - DNA, 2162 bp, Homo sapiens
gctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatc

SEQ ID NO: 6889 - DNA, 1934 bp, Homo sapiens
gaccggaggatgttccctgctcaggaggaggccgacaggaccgtgtttgttgggaatttagaggcccgagttcgggaagagattctgtacgagctgttccttcaggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgtttttaatgaa

SEQ ID NO: 6890 - DNA, 7269 bp, Homo sapiens
gtccgtttgtccggaccggaggggcagtgggcgccatcttcttctgggctcactgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggaggccccttgaggaggactggaggcggccactggaggaggatttcaggcggtctcccacggaggacttcaggcagctccccgaggaggacttcaggcaaccccctgaggaggacttaaggtggctcccagaggaagatttcaggcggccacctgaggaggactggagacggcccccagaggaggactttaggcggcctcttcagggagaatggaggcgaccacccgaggatgacttcaggcggcccccagaggaggatttcaggcattcccctgaggaggacttcaggcagtcaccccaggagcatttccggaggccacctcaggagcatttccgtcggccacccccagagcatttccggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtagagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaagcacctcagtatgattctttaaagtataagcttgtaagtagctaggataatgttaaattgattgtttggaatatccaaaccaagcacaatgaagaaagtagaaatgatatttttaattgagcaaagattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgttaagtagtgaccttgctgcctctgtttttgcagtaaatattagctgttgtttattgagctgtattagatactatatgatgtataattatgtatgaattaactatcatttaattctgataatcctagtaaatgtactacaggttgagtattcctaatctggtaatctgaaatttcacatgctccgaaaatcacaaactttttgagtgccaacatgatgctcaaagaaaatgctcattgcagcatttaagatttcagatttttgggttaggaatgttgaactggtataatgcaaatactccaaaatctgaagaaatccaaagtcttaaatacttctggtcccaagcacttcagataaaggatactcaatttgtattcctattttggagataagagatggagacttacaggctgggttggttggattggttgcctgttttttgttgttgttgtagtggaagctaggaatggtttttcacattttttaagtgtacttaagtcttacatggttacatagttacctgtataatagtcttgaatttgcctaaacccacgaagaataacagtatttgctatctggccctttaagaagtttgccaacctaggctggtctaaataatgaaaattttacattaatgaaagtattttcatggatagtattccttttgttcttagaatatttctttgaggtaggcagaatgtatgttttattccagaattactgttttacgcagttttaactttacaaacaaggcaaataatgctcaagagaagttgctatttagtaagcagcaaaataataactctgttgttttcccccgaagtacaaccaaatttaaatactgagtgaggaagcagtaaatatccaatgatatcttgagtttcttaagaatatcaatttagggttttaaa

SEQ ID NO: 6891 - DNA, 6001 bp, Homo sapiens
gtccgtttgtccggaccggaggggcagtgggcgccatcttcttctgggctcactgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtagagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaagcacctcagtatgattctttaaagtataagcttgtaagtagctaggataatgttaaattgattgtttggaatatccaaaccaagcacaatgaagaaagtagaaatgatatttttaattgagcaaagattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgtt

SEQ ID NO: 6892 - DNA, 579 bp, Homo sapiens
cggaggggcagtgggcgccatcttcttctgggctcactgagggtctacctgttttggggaggctgctgcgacgaagagttccctcagcctccggccttgtgtgtccgactcggcagcagtggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggc

SEQ ID NO: 6893 - DNA, 615 bp, Homo sapiens
ccgactcttcctttcccgtcagcttccatgtggtggtgtatgtgcgcttcccagggatcttgagagtgaagatctcgaaggatttcatagttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccat

SEQ ID NO: 6894 - DNA, 588 bp, Homo sapiens
tacctgttttggggaggctgctgcgacgaagagttccctcagcctccggccttgtgtgtccgactcggcagcagtgcttccatgtggtggtgtatgtgcgcttcccagggatcttgagagtgaagatctcgaaggatttcatagttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatg

SEQ ID NO: 6895 - DNA, 452 bp, Homo sapiens
gggcgccatcttcttctgggctcactgagggtctacctgttttggggaggctgctgcgacgaagagttccctcagcctccggccttgtgtgtccgactcggcagcagtggtgtgtgtttattgccaattaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactat

SEQ ID NO: 6896 - DNA, 3043 bp, Homo sapiens
taacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgtttgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtgtccgtgtggttatatcttctctcgttcacttactggcatagactgcagttctctgacaggcttgtttccactcaggactctggccagcatgtccacgtggggtgcttcttctaagtgccttctctgcagagggttctggctagagagtcaaactgagaggcaactctctttaccctttatgcctgcctacctctgttgttagagatgagaatagagaccagctgtttccattgcaaatgtcactatttgaaaagaagttgttaatggaaatctctgcaagtatcgtactgtgtttagtctctcgtggtagagatttcaaaagaagaaatgtatgtatcctaaatatgctgaaagcagtctgatgaaaggtttttaaatttcaggtgttaacttggtcaactctttgttaggaggttgtctgtactttaagtaaaattattctttggtttactggt

SEQ ID NO: 6897 - DNA, 3624 bp, Homo sapiens
tagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaa

SEQ ID NO: 6898 - DNA, 3693 bp, Homo sapiens
tagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcagaatgtaactaagttatctgtgaaggacaggttgggttttgtatcaaagccatctgtttcagcaactgaaaaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctcttt

SEQ ID NO: 6899 - DNA, 3621 bp, Homo sapiens
tagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctcttt

SEQ ID NO: 6900 - DNA, 1404 bp, Homo sapiens
cccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataattaaaaaaaa

SEQ ID NO: 6901 - DNA, 7058 bp, Homo sapiens
attgcagaagattcttccataaagaagtgatctgtagaacacttgcttctttatcccaccatatagtcttattagttgtgggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctg

SEQ ID NO: 6902 - DNA, 10149 bp, Homo sapiens
atgttgcggtagtttgttgttttcttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgccccaggctccccctccaccgccaccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtgggggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcc

SEQ ID NO: 6903 - DNA, 547 bp, Homo sapiens
cttcccacatgctttcagaagtggagcatgcctcatttctttctcttgcttttcatcattgtccatatcaggtcattttcagtcaggcacaggaagtgcagttttccactgtagtttggataggttcagtactctaaaataaaaccagtcactgcagatagatttccattgcagaagattcttccataaagaagtgatctgtagaacacttgcttctttatcccaccatatagtcttattagttgtgcagggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggag

SEQ ID NO: 6904 - DNA, 1852 bp, Homo sapiens
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaacctt

SEQ ID NO: 6905 - DNA, 990 bp, Homo sapiens
gacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatag

SEQ ID NO: 6906 - DNA, 1662 bp, Homo sapiens
acccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttgaaa

SEQ ID NO: 6907 - DNA, 672 bp, Homo sapiens
gacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaaggcatcattcccaacccaccataa

SEQ ID NO: 6908 - DNA, 2579 bp, Homo sapiens
aagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattacc

SEQ ID NO: 6909 - DNA, 680 bp, Homo sapiens
ggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaaggtattatacctgaagaaccttagccctcgggtgactgaaagagatcttgtgtcattgttcgctcggttccaggagaaaaaaggacctccaatt

SEQ ID NO: 6910 - DNA, 4282 bp, Homo sapiens
gttacccaacaggcgccgcggctgctccggtggcgccactgactcggaggcggctgcggagagcggggcgctggcccgtggaggcggcagcggcggcggctttctagcggatccgagattatatatctttgaatgatgcaggccactgcagtggtggagacagcatctggtaaaggctaccacagtaatggaggcaacctccaaaaagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagtggttctatcatctctttcgattcacttgatgtttatggacaagaagagtcacttcatgtctccaaatttcagaattctgttatgttaagagaatatcatgacctaaagcatgaaaagtataaggaacaagagactaattcaatgtaccacactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaacttcctggacctctgtttttgatgattcgataatttctgcctgtggatattatgaaagcctacaaaacactgctgactcagccttagatttttctgctatgctaccaaagatcgcagtcagagataatcaggcaatagaagataatacgtccctaaaagttgctcatagcagtaccacaaagaaaacatgctttcacaatataggagaaatgtgtactaaatcattgacagatgcagcaagttgtacagtcacaattaatcagacagtggacgttagcactgattttagggcttgtttcacaaccagcagggcaacaagtgcaagaccttctgtagtatctacatcaagcaacacagagataacaatgatgaataaaaaacgacctgatgaatggcaaaatgagaaacaaaaaagtgtggcttgtagtacagattggtcatacagtgaagattgtatagatacacagatggctataacaaaaggatcaggaaaatctctctccgttgacagtttaaaacctaatggaaattttctaaataaggatttcctggaattaagaaaagcatgtggtatcacagacctaaagaaacatcctgagagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaatagggaaggattaaatatgaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagagaacttccttggaaagtgtgtttcctccttcagagaatgttctacagcacttaggaaaaagtagtaataacaagatgatgtaattaaataggctctataaatgggctaagctgttaaaatattctactttatatccctcctttaaaatctagcaacagttgtctatacaatattaagatcttctctatatatttaaagttaaaatataatttttaataagtttttaaatttttttatttcaattttgttacttagaacattaagatgcatatttgtgatctaaagaaattgtcttgtccattttaaaaacctttattaagtcacttttaaaatgtattgaccaagaaggaggtttgttgttacatcaatgtttgtgaaatgatttccatacataaaaaatgtaatttacctgaactttgtcttaagactcttacattggattataggataacagataaataaactgtatagatacattcagtatcatacaacattttggaatgtgtatgctttcaggcttccaagataattaaattactgtcatgatacatttcatgcattttttatgacttcagtataaaacattcaggtgtgttagccttccctgggaagggtaaacttgtatgtgctttggtaaagtacttaaattccaatgttccctatagtgcttgcattcattttgtgaaaagttttgttgtattgttagaacaattttcaaaggctgattttatgccttatctgatagaaatatagaatagatagttctttaattgcttactttttaaaagtaatataatatttaagttgcatttttattaatagtaagattaacatttaagtctgcattttctttaaatgttttaaatgtttatagcattcaatgtgtagttggatttacttgactaaaaattagccctttaacgtttatatttgttgtatttatatttaataaaggcatctaatctttagt

SEQ ID NO: 6911 - DNA, 3449 bp, Homo sapiens
gaaattcgcacatatgcttcttcttgccgtggagactgatggagcctctgctgcggggcggggactctagcgagagggggacgtgaagttcgttccgtactcaggcgtgtgtgcccctgaccgacgcgtaggacgccctggaggacggcgccagctcctgacctagtgtgaggtgcccggacggtttccctaagaagcgcgtatttaagatgagatctgaagttgagcgtgaactcaagattatatatctttgaatgatgcaggccactgcagtggtggagacagcatctggtaaaggctaccacagtaatggaggcaacctccaaaaagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagtggttctatcatctctttcgattcacttgatgtttatggacaagaagagtcacttcatgtctccaaatttcagaattctgttatgttaagagaatatcatgacctaaagcatgaaaagtataaggaacaagagactaattcaatgtaccacactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaacttcctggacctctgtttttgatgattcgataatttctgcctgtggatattatgaaagcctacaaaacactgctgactcagccttagatttttctgctatgctaccaaagatcgcagtcagagataatcaggcaatagaagataatacgtccctaaaagttgctcatagcagtaccacaaagaaaacatgctttcacaatataggagaaatgtgtactaaatcattgacagatgcagcaagttgtacagtcacaattaatcagacagtggacgttagcactgattttagggcttgtttcacaaccagcagggcaacaagtgcaagaccttctgtagtatctacatcaagcaacacagagataacaatgatgaataaaaaacgacctgatgaatggcaaaatgagaaacaaaaaagtgtggcttgtagtacagattggtcatacagtgaagattgtatagatacacagatggctataacaaaaggatcaggaaaatctctctccgttgacagtttaaaacctaatggaaattttctaaataaggatttcctggaattaagaaaagcatgtggtatcacagacctaaagaaacatcctgagagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaatagggaaggattaaatatgaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagaggtaaagtaatcata

SEQ ID NO: 6912 - DNA, 2583 bp, Homo sapiens
gattggatgaggcaccactcctcgtggggctgcttaggccaccgcgcgcgctgcgcgctgggaaacgagtggagacacgaggaccagcgcgagcggtcccggtgggctaccctccccctgcgacgaccccccctcgctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttggactacaatttccatcgcagctcaataaatagtctttcccctgttagtgctaccctctcttctgggactcccagcgtgcttccttatacttcaaggccttattcttatccaggctatcctttgtcaccaacaatatcacttgctaatggcagccatgttggacagcggctatgtatctccaatcaggcctccttcttctgaagaaaatactaacattagtatgaaaatttgtgtaaatttgtagtatgaaaacttgcaaattaaaatattgttttattttagaatcgggtttgcatatttggttttaaaaaggtatttattccaaagtactaaacatcagctataattcagaataacatggagttgtagaatttataaaaatgcaaagtttaaaaagttattcagtggtttctcttgataaaggtacagcaaactactattctttttaaacttctaggattttcttctactttctgagtgggcaatagaacctagtcatttatgtttttttttttttttgcataattttactaaatagtatttcacaaatattaaagcacttgaagacaatggttatagtagatttgattaccaaggatcactatctgtactggagattagaacaattatatgaccagaagcatctaaccattatgtaaaaagaaatgatgagacaaaaagattaagatacaaattttgtgcagtactaaagaaaaagcagtctaccattgtggtccttgaaaataactatagatatttttgttatttgttagacacaaattataattttgttgttaatgtatttaagcattttatagttatgctttgtgtttttgatattctttgtattgttaataacaagtgttatgggtttttaatgttgaaatcatgtgttaatttttgtacttgaattcaaattttttgacattaaatatgtgatgcttcta

SEQ ID NO: 6913 - DNA, 1742 bp, Homo sapiens
gggcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattataatacaa

SEQ ID NO: 6914 - DNA, 1236 bp, Homo sapiens
atggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagcca

SEQ ID NO: 6915 - DNA, 1714 bp, Homo sapiens
gggcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttctggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagcc

SEQ ID NO: 6916 - DNA, 1528 bp, Homo sapiens
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 6917 - DNA, 798 bp, Homo sapiens
cctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtag

SEQ ID NO: 6918 - DNA, 1523 bp, Homo sapiens
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 6919 - DNA, 3469 bp, Homo sapiens
atcacttcccacttcctctgacccaccattcggcagggagacatgatggaagcggatcgcccagagaagcttttcattgggggcctcaacctcaaaaccgacgagaaagccctcaaagccgagtttggcaagtatggccacatcatcaaggtgttcctgatgaaagaccgaaaaaccaacaagtcgaggggcttcgcgttcgtcaccttcgaaagccctgcagacgccaaggctgccgccagagatatgaacggcaagtacctggatggtaaggccatcatggtggcccagaccatcaaaccggcattcaagagcagccgatgggtcccgccaacccccggcagcggcagtcgctcaaggttctcacacagaacccgtgggggtggcagcagcccacagcgacccccctctcagggcaggcctgatgacggccgcggctacgcggggtatttcgacctgtggccctacagggccccgatgcccaggaagcgcgggccgccaccgcggcactgggccagcccaccccacaagagggccacgccgtcgagcctggctcacagcgttggctgtggaatgcgcgggaaggcaccgactgtgtcggggcaagatggctactcaggcttgcagccacggcgctgggccggcccaccccacaagagggctgtgccccggtcaagcctggctcgcattggcggcagtggaatgcctgggaaggccccggccgtgtgggggcaagatggctactcaggcccgcgggtccgggagccactgcccccgtgccgcgaccctggggattttgtccctgcgctcagagactacagccgccgctattatggccactccagtgtcccggactaccgtcccttgagaggcgacggcaaccaaaatggctacaggggtcgcgaccatgagtacacagatcatcccagcaaaggctcctaccgagagcccctcaagagctacggaggcccatgcggcgctgcccctgtgtgggggacaccgccatcttatggaggaggatgccgctacgaggagtaccagggcaactcgcccgatgcctgcagtgaaggccgctcgtccgaggccttgccagtcgtcttgccagacgcctacagcagggaccactcgcccaaagcctatagtgggggccgcagcagttccagtaacggttacagccggagtgaccgctacggagaagaaggctgctacgaggagtacagaggccgctcgcccgacgcccacagcgggggccgcaacagttccagcaacagttacggccagagccaccactatggaggagaaggccgctatgaggagtaccgaggccgctcacacgaggcccgcagcgggggccgctccactgatgcccacagcaggggccggtccgacgacgcctacagtgggggccatgacagttccagctggagcgactgctgcggaggaggaggccgttatgaggagtaccaaggccgctcgctggatgccaacagtggaggctgctcgcccgaggcctacagtgggggccacgacaattccagctggagcgaccgctacggagtaggaggccactatgaggagaaccgaggccactctctggatgccaacagcggaggccgttcacccgacacccacagtgggggccacagcagttccagcaacagttacggccagagccaccgctatggaggagaaggccgctatgagtaccgaggccgctcgcatgacgcccacagtgggggctgctctgccgacgcctacagtgggggccacgacagttccagccagagcaaccgctacggaggaggaggctgctacgaggagtaccgaggccgctccctcgatgccaacagtggaggccgctcgcccaatgcctacagcgggggccacgacagttccagctggagccaccgctacggaggaggaggccgctacgaggagtaccgaggccgctcccttgatgccaacagtggaggccgctcgcctgatgcctacagtgggggccacgacagttctggccagagcaactgctacggaggaggaggccgctacgaggagtaccgaggccgcttgctcgatgccaacagtggaggccgctcgcctgatgcctacagtgggggccacgacagttccagccagagcaaccgctatggaggaggcggccgctacgaggagtaccgaggccactcgcttgatgccaacagcggaggccgctcgcctgacacctacagccggggccacgacagttccagccagagcgaccactatggaggaggaggtcgctcactcgatgccaacagcagtggccgcttgcctgacgcctacagtgggggccatgacagttccagccggagccaccgctacggaggaggaggccgctacgaggagtaccgaggccgctcgctcgatgccaacagcggaggccgctcacccaatgcctacagcgggggccacaacagttccagccggaacgacccctgcagaggaggaggccgctacgaggagaaccgaggtcactctctcgatgccaacagcggaggccactcacccaacgcctacagtgggggccgtgacagttccagcaacagttacgaccggagccaccgctatggaggaggaggccactacgaagagtaccgaggccgctcgcacgacacccacagcaggggccgatcgcccgatgcccacagcggggaccactacaccgaagcctacagcaggggccgcgacagtttcagcaacagctatggccggagtgaccattacggaagaggaggctgctacgaggaataccaaggccgctcgcccaatgcctacggcgggggccgcggcctcaacagttccaacaacagtcatggccggagccaccgctacggaggaggaggccgctacgaggagtaccgaggcccctcgcctgacgcccacagtgggggccgcgacagttccatcaagagttacggcctgagcgaccgctacggaggaggaggccactacgaggagtaccagggcagcttgcctgacgcctacagcggcgaccacgacagatccagcaacagttacggccggagcgaccgctactcgaggggtcgagaccgggtaggcagaccggatcgtgggctccctctgcccatggaaacgggcagccctcccctgcatgattcttacagccggtcaggctgcagggtgcccaggggcggaggccgtcaaggaggccgcttcgagaggggggaaggccggagcagatactaagcaggaacagacttgggcccaaaaattccttttcaaagaaacaaaaagaagaacctgttctatgttaactacccaaggactagtataagtaggagttgtttttaccttttaagaatttcctgttaagatctccatttttatgcttttgtgaggaaaaacttaaaattagtttgaaattgttaatgtttctttcaacaagttcttgttaaaagtataagatatg

SEQ ID NO: 6920 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 6921 - DNA, 1769 bp, Homo sapiens
atggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 6922 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 6923 - DNA, 1491 bp, Homo sapiens
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgc

SEQ ID NO: 6924 - DNA, 1491 bp, Homo sapiens
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgc

SEQ ID NO: 6925 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 6926 - DNA, 1881 bp, Homo sapiens
agctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 6927 - DNA, 2008 bp, Homo sapiens
actcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtccggacactgtttgtcagcggcctccctgtggacattaaacccagagaactctacttgctcttccggccgttcaaggggtatgaagggtccctgatcaagctcactgcaagacagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtgcgctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaacc

SEQ ID NO: 6928 - DNA, 978 bp, Homo sapiens
agttcggcccaatggcggcaccgctgcttcacacgcgtttgccgggagatgcggccgcttcgccctctgcagtcaagatgctgggcgcgtcgaggactgggatttcaaatatgcgtgcattagagaatgattttttcaattctcccccaagaaaaactgttcagtttggtggaactgtgacagaagtcttgctgaagtacaaaacgggtgaaacaaatgactttgagttgttgaagaaccagctgttagatccagacataaaggatgaccagatcatcaactggctgctagaattccgttcttctatcatgtacttgacaaaagactttgagcaacttatcagtattatattgagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacgtcacagagccttgcaaataatagcaagatatgtaccattgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaaatcaaacttgtggtgggacagattccacggaaggattgtgtaatatggttagcagtttattaatgaaagtggagatgaagtttatcataatcaaagggtggaaacagctagtgctgctcatctttggattcgcagaggcatttttggaacctctttgg

SEQ ID NO: 6929 - DNA, 1214 bp, Homo sapiens
gtcgctcttttgttggtctggctgacttctgttcctcttttaaaaatttaagtttggccgggtgcggtggctcacggggcccctgattgtctgaaggttgcgctggcacgcgcaacttccgggacagaggctgtggctggaaggagctgggcatccggcctgaggcgcagcggtcgcgttagttcggcccaatggcggcaccgctgcttcacacgcgtttgccgggagatgcggccgcttcgccctctgcagtcaagatgctgggcgcgtcgaggactgggatttcaaatatgcgtgcattagagaatgattttttcaattctcccccaagaaaaactgttcagtttggtggaactgtgacagaagtcttgctgaagtacaaaacgggtgaaacaaatgactttgagttgttgaagaaccagctgttagatccagacataaaggatgaccagatcatcaactggctgctagaattccgttcttctatcatgtacttgacaaaagactttgagcaacttatcagtattatattgagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacgtcacagagccttgcaaataatagcaagatatgtaccattgaatgttacgttcataacttactaaggattagtgtatattttccaaccttgaggcatgaaattctggagcttattattgaaaaactactcaagttggatgtgaatgcatcccggcagggtattgaagatgctgaagaaacagcaaatcaaacttgtggtgggacagattccacggaaggattgtgtaatatgggattcgcagaggcatttttggaacctctttggaaaaaattgcaggatccaagtaatcctgccatcatcaggcaggctgctggaaattatattggaagctttttggcaagagctaaatttattcctcttatgattcgggaacaaaggcattctgcgatgttgctctccatggaccattttactcagcctgccaagctgtgttctacacctttgtttttagacacaagcagcttttga

SEQ ID NO: 6930 - DNA, 1618 bp, Homo sapiens
gttagttcggcccaatggcggcaccgctgcttcacacgcgtttgccgggagatgcggccgcttcgccctctgcagtcaagatgctgggcgcgtcgaggactgggatttcaaatatgcgtgcattagagaatgattttttcaattctcccccaagaaaaactgttcagtttggtggaactgtgacagaagtcttgctgaagtacaaaacgggtgaaacaaatgactttgagttgttgaagaaccagctgttagatccagacataaagagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacgtcacagagccttgcaaataatagcaagatatgtaccattgaatgttacgttcataacttactaaggattagtgtatattttccaaccttgaggcatgaaattctggagcttattattgaaaaactactcaagttggatgtgaatgcatcccggcagggtattgaagatgctgaagaaacagcaaatcaaacttgtggtgggacagattccacggaaggattgtgtaatatggttagcagtttattaatgaaagtggagatgaagtttatcataatcaaagggtggaaacagctagtgctgctcatctttggattcgcagaggcatttttggaacctctttggaaaaaattgcaggatccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagtggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccactggaggagactcagtgcagacctgcacaaacccactggacaccttcttcccctttgatccctgtgtgctgaagaggtcaaagaaattcattgatcctatttatcaggtatgggaagacatgagtgctgaagagctacaggagttcaagaaacccatgaaaaagttgttctggagaatcatgtagcgacagatgaagacgaacctgctttgaaatgccagcgactagaaatcaattgccaggatccatctataaagtcattcctgtattccatcaaccagacaatctgcttgcggttggatagcattgaagccaaattgcaagccctg

SEQ ID NO: 6931 - DNA, 2050 bp, Homo sapiens
gggcggaagcgctgccaggcgtccggagcggagcttccagggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggctccaagga

SEQ ID NO: 6932 - DNA, 1875 bp, Homo sapiens
gatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaaca

SEQ ID NO: 6933 - DNA, 1773 bp, Homo sapiens
atgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtagccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaac

SEQ ID NO: 6934 - DNA, 1225 bp, Homo sapiens
acatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 6935 - DNA, 1178 bp, Homo sapiens
atgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 6936 - DNA, 1735 bp, Homo sapiens
tcctgggggcgccccgggagctccgcccccaagcgggcgccccaggctggtgccggccgcgtccctggccagccggagcaagcctgactcgtgcagccgccggccgcgtccctggccaggcggagcgagcctcactcccgcagccgccagtctggttccagggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 6937 - DNA, 7091 bp, Homo sapiens
attaattgtggctggacgcagtggcgcggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtggtaaatcagactgtgaagtgcttgaagttttctacatttccttggctacccctgaccaccacagacagacatgtcctctcctctaatgaaagctctttaagaagtagtaaccacactttaatctggaacacctgtgaactattgaaggatgttatcatgcaagattttcctgctgagattttccttcaaaggccaaaaattgttcagagccttttatctctgttgaaactggcctttggagatggaaagcatcgcctggcattacagtcggtgtcctgcctgcagcagctgtgcatgtatttaagaaacagacttaactttcaccgagatccaggttttttctccaataaacacgacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctagtggaagtagtagtcatgctcatgtaaactccaggatatccgttcattcacctttggatatgggacacatagatctgccagagctggaaactgaagacacattggaactacaattccagcagctcagtcttccccagttttgtgtctccattctggaatcagctgttcctctcttaagaacaggtagcagacaagtgataataagagttctggaattgcttacagaggatatgacacttattggtgaagcaatttcaacagatatctgggatgacagcagcctttttggtatagatatgaaggagaaactactcctggtgttgggagcccttggagaaaccatgtgctaccataaaagtagtatcagtttggagcagccagaggtgatgcttgtgcaccacagaatggcctttatcagcatttccctgtttgcagttcgactgctacaaacgcttctccctgttgaaaaggcaagcgagtttttatcagagcctatgtcaacagcattatttctcctttctttggacatgcctatttctttggaatatccaaatattcatgaagctgttgtggcctatttggaacagctgaattctgaaaactacagtatttataaacgaactgcagaggccgtttattcaattgaatgcacctgtaacttcctgtctgatattgggaaagagggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtttagatgactcattcaagttttggagggctccatctaggacaagtcaggatcgagatccaagttctctctccacctcagaaacaacggtggcaccttcattggggagtactgaatttcagccacttgtgcagtcaacaacacttctacctgaagcctcccatgaccagtttgtggctcaaggtcaccaggaaagtacatcaccacggccacctcatgattcatctctttctgctcccctgcccaaactgtgtgtttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtttgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaact

SEQ ID NO: 6938 - DNA, 4850 bp, Homo sapiens
attaattgtggctggacgcagtggcgcggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtggtaaatcagactgtgaagtgcttgaagttttctacatttccttggctacccctgaccaccacagacagacatgtcctctcctctaatgaaagctctttaagaagtagtaaccacactttaatctggaacacctgtgaactattgaaggatgttatcatgcaagattttcctgctgagattttccttcaaaggccaaaaattgttcagagccttttatctctgttgaaactggcctttggagatggaaagcatcgcctggcattacagtcggtgtcctgcctgcagcagctgtgcatgtatttaagaaacagacttaactttcaccgagatccaggttttttctccaataaacacgacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctagtggaagtagtagtcatgctcatgtaaactccaggatatccgttcattcacctttggatatgggacacatagatctgccagagctggaaactgaagacacattggaactacaattccagcagctcagtcttccccagttttgtgtctccattctggaatcagctgttcctctcttaagaacaggtagcagacaagtgataataagagttctggaattgcttacagaggatatgacacttattggtgaagcaatttcaacagatatctgggatgacagcagcctttttggtatagatatgaaggagaaactactcctggtgttgggagcccttggagaaaccatgtgctaccataaaagtagtatcagtttggagcagccagaggtgatgcttgtgcaccacagaatggcctttatcagcatttccctgtttgcagttcgactgctacaaacgcttctccctgttgaaaaggcaagcgagtttttatcagagcctatgtcaacagcattatttctcctttctttggacatgcctatttctttggaatatccaaatattcatgaagctgttgtggcctatttggaacagctgaattctgaaaactacagtatttataaacgaactgcagaggccgtttattcaattgaatgcacctgtaacttcctgtctgatattgggaaagagggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtttagatgactcattcaagttttggagggctccatctaggacaagtcaggatcgagatccaagttctctctccacctcagaaacaacggtggcaccttcattggggagtactgaatttcagccacttgtgcagtcaacaacacttctacctgaagcctcccatgaccagtttgtggctcaagggaatcgacactttggaacaaatatccaattttag

SEQ ID NO: 6939 - DNA, 7002 bp, Homo sapiens
attaattgtggctggacgcagtggcgcggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtggtaaatcagactgtgaagtgcttgaagttttctacatttccttggctacccctgaccaccacagacagacatgtcctctcctctaatgaaagctctttaagaagtagtaaccacactttaatctggaacacctgtgaactattgaaggatgttatcatgcaagattttcctgctgagattttccttcaaaggccaaaaattgttcagagccttttatctctgttgaaactggcctttggagatggaaagcatcgcctggcattacagtcggtgtcctgcctgcagcagctgtgcatgtatttaagaaacagacttaactttcaccgagatccaggttttttctccaataaacacgacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctagtggaagtagtagtcatgctcatgtaaactccaggatatccgttcattcacctttggatatgggacacatagatctgccagagctggaaactgaagacacattggaactacaattccagcagctcagtcttccccagttttgtgtctccattctggaatcagctgttcctctcttaagaacaggtagcagacaagtgataataagagttctggaattgcttacagaggatatgacacttattggtgaagcaatttcaacagatatctgggatgacagcagcctttttggtatagatatgaaggagaaactactcctggtgttgggagcccttggagaaaccatgtgctaccataaaagtagtatcagtttggagcagccagaggtgatgcttgtgcaccacagaatggcctttatcagcatttccctgtttgcagttcgactgctacaaacgcttctccctgttgaaaaggcaagcgagtttttatcagagcctatgtcaacagcattatttctcctttctttggacatgcctatttctttggaatatccaaatattcatgaagctgttgtggcctatttggaacagctgaattctgaaaactacagtatttataaacgaactgcagaggccgtttattcaattgaatgcacctgtaacttcctgtctgatattgggaaagagggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtttagatgactcattcaagttttggagggctccatctaggacaagtcaggatcgagatccaagttctctctccacctcagaaacaacggtggcaccttcattggggagtactgaatttcagccacttgtgcagtcaacaacacttctacctgaagcctcccatgaccagtttgtggctcaaggtcaccaggaaagtacatcaccacggccacctcatgattcatctctttctgctcccctgcccaaactgtgtgtttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtttgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaact

SEQ ID NO: 6940 - DNA, 447 bp, Homo sapiens
cgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaacctcttgagt

SEQ ID NO: 6941 - DNA, 1538 bp, Homo sapiens
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcatgcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 6942 - DNA, 1679 bp, Homo sapiens
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 6943 - DNA, 2654 bp, Homo sapiens
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggtaagcgtctcctgggacccactctgtggtaagagggacctgtggttggttttattcccaccttgatagaaataatgacctataaacaggtaaatgtttaatgcagtttattatctgaggaatttacctgcatagaaaagtgaaggtaacaagtcatttagactcaaaggccagtcagaaagaagggaagaggcagcatgggatcacggcaagaggattggtctgggagttaggacgcctggctccacacctgctcttctttgatcagtagtagtggttttggattcagctggtcatttcatagtcataagacccagataggccatgctggcaccacttttgcggaaggaaacagggcagaagcatagcagggcagcattaggtttgtctgtcagtggagtttttacagaggtccaagggctattcgctaacctgagtgacaactgaggtgtgagggccaggaacacaagtgggtaagggaaccacctgtcttagaagcgtgctataggaaccaatatctcttataatccatgtcctttccatatatgtgtatgtatgtatgtacatgtgtatatatatcacacaaacacacataaaaccaatatgatacgtattattattgcttttagatcccaggcagggggagccttgggattaggagcacactgtacttcaggaagttcatagccatggctttctactgggaatttagaattccttcatggccctgtcattccaaatgcagttaacctacagaggtcatttttattataagcagcattgcctggtaacagccatttcacctttatcaagtttcttccataggtattctactcattcattaaaaaaaaaatgaattgaggactcattaacattgagaaatacacatctctcacagagctcaagccttgggttggtaataagagaacagaataaacaggcagtaccctggagagctgtacaaggagggcttatgggagttcagaggagggtgatctcctttatggtgacaccttcctggaggaggcatttaacttggccttgaagcatggaatcgatctggacagacatggagatctggtgagttgtgggggtagagcttaagtggaagatccccacatagaagaacaaggcagagaagcaggaaactggagtatatacaaagagcatcttgttctacttagctggagcattaggttcatgagggagaggatagttcctgttaggaataggaaacagattcagagaagtgatgtaatctggccaaaattttactactaataagcgatagagctggtgttagaccccaggtctttgtggttccagtgcccctgctgtttcctgctccaggctcaggccttggtggaaggatgccattttccatcagcttgtatggaaagagacatagcaggtgaaagtttaaataaaacccctcactacttcctgttgactac

SEQ ID NO: 6944 - DNA, 1362 bp, Homo sapiens
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 6945 - DNA, 1474 bp, Homo sapiens
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 6946 - DNA, 2478 bp, Homo sapiens
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagtcttctgagttgacagagcagaagcttcgtgcctgtttagagggtagtataaatgagcacagtgcacattgtccccacacacctgaattttcagtcactggaggaacagaagaaaagtccagtcttctcatgagctgtctggtaagcgtctcctgggacccactctgtggtaagagggacctgtggttggttttattcccaccttgatagaaataatgacctataaacaggtaaatgtttaatgcagtttattatctgaggaatttacctgcatagaaaagtgaaggtaacaagtcatttagactcaaaggccagtcagaaagaagggaagaggcagcatgggatcacggcaagaggattggtctgggagttaggacgcctggctccacacctgctcttctttgatcagtagtagtggttttggattcagctggtcatttcatagtcataagacccagataggccatgctggcaccacttttgcggaaggaaacagggcagaagcatagcagggcagcattaggtttgtctgtcagtggagtttttacagaggtccaagggctattcgctaacctgagtgacaactgaggtgtgagggccaggaacacaagtgggtaagggaaccacctgtcttagaagcgtgctataggaaccaatatctcttataatccatgtcctttccatatatgtgtatgtatgtatgtacatgtgtatatatatcacacaaacacacataaaaccaatatgatacgtattattattgcttttagatcccaggcagggggagccttgggattaggagcacactgtacttcaggaagttcatagccatggctttctactgggaatttagaattccttcatggccctgtcattccaaatgcagttaacctacagaggtcatttttattataagcagcattgcctggtaacagccatttcacctttatcaagtttcttccataggtattctactcattcattaaaaaaaaaatgaattgaggactcattaacattgagaaatacacatctctcacagagctcaagccttgggttggtaataagagaacagaataaacaggcagtaccctggagagctgtacaaggagggcttatgggagttcagaggagggtgatctcctttatggtgacaccttcctggaggaggcatttaacttggccttgaagcatggaatcgatctggacagacatggagatctggtgagttgtgggggtagagcttaagtggaagatccccacatagaagaacaaggcagagaagcaggaaactggagtatatacaaagagcatcttgttctacttagctggagcattaggttcatgagggagaggatagttcctgttaggaataggaaacagattcagagaagtgatgtaatctggccaaaattttactactaataagcgatagagctggtgttagaccccaggtctttgtggttccagtgcccctgctgtttcctgctccaggctcaggccttggtggaaggatgccattttccatcagcttgtatggaaagagacatagcaggtgaaagtttaaataaaacccctcactacttcctgttgactac

SEQ ID NO: 6947 - DNA, 2033 bp, Homo sapiens
ttttcttataaaaatattgaagttaaatacaagaaatcctagatggccaaagaaggcagggagtggagctaagcacaggaaaatgcaacgacttacaaataaaaacaggaaagatgaaaatcacaatgttttagctaatttttaatattaaatggtgaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggacttggctatcatttggagtaattgcaggtctttgctcttggccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagtattctgggcatactacatgttatattgaaaaaaaaaaatcacaaaacaacttctagacattgtgtggctctttcacgtttgagtttgtgagttttcccccaaactttgttttcatttagaaatgtttctatttccccatttttcttttatttgtcttcttcacccttttacaccctagttctagcctcagttttacccaaagttgatttgaattacaccagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcatt

SEQ ID NO: 6948 - DNA, 983 bp, Homo sapiens
agatgcggtggtggccgccgagcgcctggaaggagctgctggacaggccgagggagcctccgcccgagaccgcgcagccgccgccgccatggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggtatgattttcataagttatttcacatattgggttttttatatagctctttacaaatcattataagatccatctatttacagtgtggttttattttgttgttttcccccctgtgacttcttcatttcattttcacttccattacaagctttacaaagcagattatggaaaatcacttaggagaaggaggttttattaatagtatgaagtgggacctttggttatacctgtagttactgagacccattttaatagtggttttttggaataaaagagatgaaagcttattattcacaagtttgcaaatactgg

SEQ ID NO: 6949 - DNA, 4512 bp, Homo sapiens
atgggtaaggcgagcgggccgaaaccgaacgctaggccctcagtcccgggctgagggccgcggccaggcggggtggactgggagctgggggagacgccgaggccgccagtcggaactggggcccgaacccaggatgggcggggactgcctgggactcgggggctcccggggtcgtcatggcaacgcgccccctcccttgttccggcccgttcccgcccgggttctgaggcatagtggccgagggctcgaggtgccacggcgtccaggagcgaggacagggccaggcagggtgtcactcccgggtcggggagcaggcggggaggggcgatgacttttcaggtttgggggtggcggagggaagacgcatctcaggttttggcctgggtgcctgacgccgagggcgggagacggggaatgctgacgcgcaggagcctggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcattaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgactgacttgctttttttttttttttttttttttttaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttaacataccattccctcacctagcagtactaccacaataatgctatcatggtgccagggaattacaattgtaattcttctaacctataatgtttaaaaaataaaatgtgaattttatgaactaaataaatatttggaaaattagcctgcttt

SEQ ID NO: 6950 - DNA, 2685 bp, Homo sapiens
gcagcgggcctggctgcagatgcggtggtggccgccgagcgcctggaaggagctgctggacaggccgagggagcctccgcccgagaccgcgcagccgccgccgccatggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaatgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagtgacaacgatttgttaactcaaactaggacaattgcaatgtcattggtgaaatgtgccagcagtgacacgcaggaccagtacaagctggttaaagatatatctttctgaagaccacttgtatttaaacagactaaatgaaaagagaatcaacaattttataatatattaaatagaaaggaatctaaatgctattaaatattctaaaaggatgttaggaaccctgtacatttcttggtcagctgctgtggtaatacactgccatcaagcagagtgggtgcacttggatttccagacatacgttcctcaaaccttgtgcacaaagggtgatttgagtattgaccctttggaggtcaggattttcaaatgcagttttatctttttagctactttttgatgaaaaatataaagattgtttaaaaataacttaaccttcagttttatactgtgttggcacagatatttttttctcattggcccactctttgcccaatggctcccttacagatttttacatatgctttaaaataatttataacccagactggccaacaccctgtgcttcagcttctcagttttccggttctcccttgccctcttctgtgatagcacaacttcaaggcctacctcactctgacttctattttcctttttgtaaccttagagaaaagcttgggtccaatcccagcacctgaatattttaatttaaacttggatttggagataacttaaatgttactctcccttccttggaagcagcatttatacccctgaaatatgtgagggttgctccattggtatggttttaaggaagaaaggaagaggaagagttttttagttagttgaaccgaaatttctcttgtgatttcctgcaaggagttaatatcctttgaatcttggtaaatattttcttataaaaatattgaagttaaatacaagaaatcctagatggccaaagaaggcagggagtggagctaagcacaggaaaatgcaacgacttacaaataaaaacaggaaagatgaaaatcacaatgttttagctaatttttaatattaaatggtgaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggacttggctatcatttggagtaattgcaggtctttgctcttggccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagt

SEQ ID NO: 6951 - DNA, 1615 bp, Homo sapiens
agatgcggtggtggccgccgagcgcctggaaggagctgctggacaggccgagggagcctccgcccgagaccgcgcagccgccgccgccatggtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagtgacaacgatttgttaactcaaactaggacaattgcaatgtcattggtgaaatgtgccagcagtgacacgcaggaccagtacaagctggttaaagatatatctttctgaagaccacttgtatttaaacagactaaatgaaaagagaatcaacaattttataatatattaaatagaaaggaatctaaatgctattaaatattctaaaaggatgttaggaaccctgtacatttcttggtcagctgctgtggtaatacactgccatcaagcagagtgggtgcacttggatttccagacatacgttcctcaaaccttgtgcacaaagggtgatttgagtattgaccctttggaggtcaggattttcaaatgcagttttatctttttagctactttttgatgaaaaatataaagattgtttaaaaataacttaaccttcagttttatactgtgttggcacagatatttttttctcattggcccactctttgcccaatggct

SEQ ID NO: 6952 - DNA, 4233 bp, Homo sapiens
gccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccgttttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaataggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatca

SEQ ID NO: 6953 - DNA, 2143 bp, Homo sapiens
gtggccgagaagaaaggtggcggtggcggcggcggcgcagcggacgggacggggcggcggctcctcgccctgaccctctgctcccccgcccaggcccgggcgcgaatcggaggctgcggcgaaggaaggagtgagcatggctgagaccccgccgccgcccaccgctggtgccgaaagttgcagcgaggagccggcgaggggcggggagtggcggccggaggagccgcgccgcgctcccgccgggggcacggaccgagagggcgaggcggggccgccgccggcctcccccgccgggcagtcggagcccgactcgccggtggccgcccccttcttcctgctgtaccccggcgatggaggcgccggcttcggagtgcgcccgccgccgcagcagcagcgctcctggaggaccccgccgtcccccggctcaccgctgcccttcctgctgctgagctacccgagcggcggcggcggcagcagcggcagcggcaagcaccatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaaggtaaaagtcctgtttctttaatgaaacactttggattgtcagtgctgaagtgaaaagaatgtgctgtacattcggcaaatagaaaatacatgaaattcttccaaattagcatcagacattctggtagaaaaaagccagttgaatgttatgtgtgttttctaaggtatgactgaaatgtttttaggaaatgtcaatcacttgactagcctttaaaaaaaaaaaagaaaggtcagccttttatgactgttttgaacatcagaactcttaatccatgtcagagtcatgtgttagaggaaggatacttaaaagcatggaaggactcttaaatgtatgtatgtaattctgtgattttattgttcatcactgaagtctttgaatacttggatgctaggggatatagaggcactgagagataggtgtcctccaaggatctattctggatctttctctcccttctttaacccttttctcttatctcccttttctttct

SEQ ID NO: 6954 - DNA, 482 bp, Homo sapiens
aaatacaggatttcagtacagcgcacaagacgggaacaaaagaggtggtggaaggaagacacccacctttggtttctcacataaagagctcaatactccaaacagtgaatcaacggttgaagttgcagtgtgtgaaaggcaaatggcccgggcgcgaatcggaggctgcggcgaaggaaggagtgagcatggctgagaccccgccgccgcccaccgctggtgccgaaagttgcagcgaggagccggcgaggggcggggagtggcggccggaggagccgcgccgcgctcccgccgggggcacggaccgagagggcgaggcggggccgccgccggcctcccccgccgggcagtcggagcccgactcgccggtggccgcccccttcttcctgctgtaccccggcgatggaggcgccggcttcggagtgcgcccgccgccgcagcagcagcgctcctggaggaccccgccgtcccccggctcaccg

SEQ ID NO: 6955 - DNA, 1421 bp, Homo sapiens
ctttgcaaattccgagtgtccatggatggagaatggctctgcctgcgagagctggatgacatctcacttacacctgacccagagcctacccatgaagactcttgggaggatttgacagatttggtggagcaaatgcgcgatgatacagaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcac

SEQ ID NO: 6956 - DNA, 3098 bp, Homo sapiens
ctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaa

SEQ ID NO: 6957 - DNA, 2760 bp, Homo sapiens
aaaaggaaactagcagcagtcccagctaccacaatggatcagcccccatttggccaacaggtgactctaccccaggtgggcctgagaggacccatcccccatctcaccattctgccccagcgccctggatcctgcctctaccacttcttccctgcagcgtctgcggttcccccaccgctgtgagccaggttccccctccaggctgctgggctgggactgagttacttcttcccaggctgtaaatcctgggactgctgtgcaaggcagagtcactagggacggactctggcagcagagctgcgctctcgtgccccagccagccaggctctcctgggatctgggctggaaggggctgccgagaccatcagtccaatctttggtctacaggttgggaaactgaggctcaaggaaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagagctgccgtctctgccatcctccagggctatggggatgggcaggggccagtgacggacaccagtgccgagctgcacagactctgtggctgcctggagctgctgctgcagtttgaccagaaagagcagaagagcttcctggggcctcggaaggattactgggactttctctgcactgccctacgacggcagcggggaaacatggagccaatccactttgtccgttcccaggacaagttgaagacccctctggggaaaggccgtgccttcatccgcttctgcctggcccgtgggcagctggctgaggccctgcagctttgcctcctgaactcagagctcaccagggaatggtatggaccccggagccctctgctctgcccagaacgccaagaagacatcctggactctctctatgctctcaatggggtggccttcgagttggacctccagcagccagacctggatggagcctggcccatgttctcagagtcacgctgctccagttccacccaaacccagggaaggagacccagaaaaaacaaagatgccccaaagaagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaagagcctcagacttgggctccggaaggctgaggagcaggcccagcgccaggagcagctgctgagggagcaggagggggagctgcaggcacttcgggagcagctcagcaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccaagagaaggaccgcctgtggcagaggctccagcatctctcttccatggctcccgagtgctgtgtggcctgtagcaagatctttggccgattttctcggcggtatccatgcaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgt

SEQ ID NO: 6958 - DNA, 2977 bp, Homo sapiens
aaatcctgggactgctgtgcaaggcagagtcactagggacggactctggcagcagagctgcgctctcgtgccccagccagccaggctctcctgggtgagtagcagggagacccctggaacttacggggatagaaggagtgtgatgccaggagccaggggaggaaaatgcctggcagagacgagggagaggaggagacacatggagccgttcatggatttcacacaggatctgggctggaaggggctgccgagaccatcagtccaatctttggtctacaggttgggaaactgaggctcaaggaaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagagctgccgtctctgccatcctccagggctatggggatgggcaggggccagtgacggacaccagtgccgagctgcacagactctgtggctgcctggagctgctgctgcagtttgaccagaaagagcagaagagcttcctggggcctcggaaggattactgggactttctctgcactgccctacgacggcagcggggaaacatggagccaatccactttgtccgttcccaggacaagttgaagacccctctggggaaaggccgtgccttcatccgcttctgcctggcccgtgggcagctggctgaggccctgcagctttgcctcctgaactcagagctcaccagggaatggtatggaccccggagccctctgctctgcccagaacgccaagaagacatcctggactctctctatgctctcaatggggtggccttcgagttggacctccagcagccagacctggatggagcctggcccatgttctcagagtcacgctgctccagttccacccaaacccagggaaggagacccagaaaaaacaaagatgccccaaagaaggtgcctctgccctgccttcactctgagttgcctcttccccatctccttggcatcctcaagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaagagcctcagacttgggctccggaaggctgaggagcaggcccagcgccaggagcagctgctgagggagcaggagggggagctgcaggcacttcgggagcagctcagcaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccaagagaaggaccgcctgtggcagaggctccagcatctctcttccatggctcccgagtgctgtgtggcctgtagcaagatctttggccgattttctcggcggtatccatgcagtgctaggaccagccttgggagagaggaaagtgagccaccaggagaagctgccatgtggaggtggaggctctggaggggtcgggcatcaggacacccttcaggagaggggagacctcctgagacaaaccaagggcattccactgggagatgagaaacagatgtctcaggtggacctgaagatgctggaactccatgacctcagcgcccacttggggaagtgccagctgcagaggccgccccaggctttcctgcctctgccttccaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgt

SEQ ID NO: 6959 - DNA, 2653 bp, Homo sapiens
aaaaggaaactagcagcagtcccagctaccacaatggatcagcccccatttggccaacaggtgactctaccccaggtgggcctgagaggacccatcccccatctcaccattctgccccagcgccctggatcctgcctctaccacttcttccctgcagcgtctgcggttcccccaccgctgtgagccaggttccccctccaggctgctgggctgggactgagttacttcttcccaggctgtaaatcctgggactgctgtgcaaggcagagtcactagggacggactctggcagcagagctgcgctctcgtgccccagccagccaggctctcctgggatctgggctggaaggggctgccgagaccatcagtccaatctttggtctacaggttgggaaactgaggctcaaggaaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagagctgccgtctctgccatcctccagggctatggggatgggcaggggccagtgacggacaccagtgccgagctgcacagactctgtggctgcctggagctgctgctgcagtttgaccagaaagagcagaagagcttcctggggcctcggaaggattactgggactttctctgcactgccctacgacggcagcggggaaacatggagccaatccactttgtccgttcccaggacaagggaatggtatggaccccggagccctctgctctgcccagaacgccaagaagacatcctggactctctctatgctctcaatggggtggccttcgagttggacctccagcagccagacctggatggagcctggcccatgttctcagagtcacgctgctccagttccacccaaacccagggaaggagacccagaaaaaacaaagatgccccaaagaagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaagagcctcagacttgggctccggaaggctgaggagcaggcccagcgccaggagcagctgctgagggagcaggagggggagctgcaggcacttcgggagcagctcagcaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccaagagaaggaccgcctgtggcagaggctccagcatctctcttccatggctcccgagtgctgtgtggcctgtagcaagatctttggccgattttctcggcggtatccatgcaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgt

SEQ ID NO: 6960 - DNA, 3828 bp, Homo sapiens
gtttccgggaagatggcggctgtcgaagcggctgcagagccggtaacggtggtggcggctgttgggccaaaggcgaaagacgaagaggaggaggaagaggagccgctgccaccgtgcgaggcggtgcgctgggccccagtgggggcggtggcggaggcccggcctggggcaaccgcgtttttagaagaggcgacggccgaggagcctggcgcggccccgggctccccgccggattcgccgggccggacgctgcggcggctgcgggcagagcggcggcggctggactcggcgctgctggcgctgtcctcgcacttcgcgcaggtgcagttccgcctgcgccaggtggtgcgcggggcgccggcggagcagcagcgccttctgcgggagctcgaagacttcgccttccgcggctgccctcacgtcctaggttacgaagggcccggcgaccccgccagcgatgagggcgatgggctgccaggggaccggccatggttgcggggcgaggaccagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacacggtgaaaccccatctctactaaaaatacaaaaaaattagtcggacatggtggcaggcacctgtagtcccagctactcgggaggctgaggcaggagaatggcgtgaacccaggaggcggagcttgcagtgagccaagatcgcgccactgcactccagcctgggcgacagagtgagactccgtctcaaaaaaaaaaagaaggttgtacccacagtatacgtgtgggcacttgtgcttgagcctgtattaaaggaatcaggccaggcacagtggctcacgcctgtaatctcagcacattgggaggctgaggtgggcggatcacctgaggtcaggagttcaagaccagcctggccaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccattgcactccagcctgggcaacacagggagactccatctcaaaaaaaaaaaaaaaaaaaaaaagacattcaacttgaggctcctgttagttaagctatcttctttcacttgaagcaggtttgagaggcctaggccagaatttaaattccttttatgaatagatttccctttcttcctgaccccaaggtcagaggagactatatattccatggctgcctctaagactaggaataggaatatctgaaaacagcatttctaagggtggtaaccacaggtcgattttaatacgagtcctttttcttgtagaggtaagtaaaatcttcctgacaaggtagtcctcttttcatggcacagacaatgggctttctgtttatgaggggtgagaagtgatgtttgttactatgttctccagcaagtaaacattcctctgctcacctcccaacaagactaacagtctttttagaagtaaatatattcaagacaaacgagaaaatcctggctacccaagtcgagtatatacaggaatacaaatcggtaaccagcagctgttcctcaggttgtgactcactgagcaccacttgtcctggaggctggatgatggaggacatctggttataggtactgtagcagggataggtgccacaggaggataggaactacagcagatcgctgtttccagaacggggaggagtatctcattgtgaaacagactctagagtggttctatttggtcttcagtgttttagcctcgttagttcatatttggcatgcagcttgtggtgagtactgttctaggactggccaaaaatgggcaaaatgtatcactccaaacactactgattcagcattgttttcatgtcttaaaattgccacctgcactttgtttctgcactattatgtagtgcattttaacttaaattttttccagcaacatgttacttatttaagatacattactgatatttcattataattagttcaccttccctgtgaaacaagagaattgtaaaatgttgtggaaaatgatacatatgtggatgctaatgaaatcatagtattttgtgtagcttctctgaagaccttagagatctgcagctttggtttataagtgtttgggccttatcagcccatctgatccagatcaatatttttttgaaaactg

SEQ ID NO: 6961 - DNA, 4099 bp, Homo sapiens
gctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtgcgtgcgtgtgtgtgtgtgtgtgtgtgtgtgtgtgtgtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaagagatttcccaaagttgcagatggctggctcatctccaaatacctcttcaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgactgtgctaaagaataatgatttaagatcgagacaagagttaactgcccatctcaccaaccagtggccttctccaggagctctggatgtcaatgctgttgccttggatacgttgctttaccgaaaacacaataaacagtggtatgagaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaaagttaatttcattttttcattaatgtcttcctaagttctatgctttaaatgccttgtttttaataacgggaaagttctcagctgcattttcacagtggcttattcagtttttctttaatatttaccatttggtatcaattcagcattccacttaacattttataaattccataggaacatgcctgttttggtagttactgacttaatttgttagtgccacaaggaaaatattttacagtattttatgccatttaggcaaaatgaataaactgttttccaagattttcttaaaagattatcaatttaaaagtatgatcaagtatgcctcaaaaactagaaacatttcaaaatgtagaacaaacgttgaaaaattgttttgccaggaaagagttcaagttcagttaaggatttgagaggcttttaaacaaggatcagtaggatagttatcatatttacttaatatatgtctgatattcagtgctggttctttttcctgtttgtgcaacaatgaagtgtgtcatgtgtgttttatagcctctatcattaatcacaccagagtctcattttaaaacattttaatgttaaaacatccccacacttatacacaggtaaaattagtttttttttttttaaagttgtaatctgtacttttttttttttgcaatttttgaaacagctacattaatccctaaaaatcccaccatactgaaaatgtatggcgtgtattttctatagtaagtaatatgaggaaaacatgattagctgtgccaaagaaattttatacattgtttacatgatgaggccacagtacttactgaggacttcatatggtttttttgtttattattattgagaaaagagctgaggttaccacattcattctttgtgttagaaatgtaggagtgtggtggttttctgcaatatttagagcttagtctcataatttggaatttaagataataagtagtaacaaggcaagtcttttatgtaagacagtcaaacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggacaatggaaactttgggagaagggagtgaggaaatggataaagagaaatttgaaaattttaggctggacttgagcactattgctgctttcctatgaactatcagaatgtttaaatgctttatcattcatggtccactctcaaccaacatttattatcctttagtaattaaacaatggttttacatacatttttataatgtagaaggaaattcaagattccataatcgtaaaatttttcagatttgtctaatgtgtaatttgtgcatcttcacatgctgctaaatgcagatttaaacattacatctgaggatcatgacttttcctcctttcttggagatcttggtataaaattcatctgctgttataaaatcaggtttctacagagttcgtttcacactaaaggtagtttgttactgtttgcatgaggaaaccatgtatgtctcaatctttaattttaggtggtagtgtttattgttcaccctccctcttgcctccaaaagaatgctgaattatacgccaatatttccatgtgtattctgttgccttgatgcgtactatacttgttgcatgtatattaaaaattttgtactatg

SEQ ID NO: 6962 - DNA, 2064 bp, Homo sapiens
gtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgactgtgctaaagaataatgatttaagatcgagacaagagttaactgcccatctcaccaaccagtggccttctccaggagctctggatgtcaatgctgttgccttggatacgttgctttaccgaaaacacaataaacagtggtatgagaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaaagttaatttcattttttcattaatgtcttcctaagttctatgctttaaatgccttg

SEQ ID NO: 6963 - DNA, 2020 bp, Homo sapiens
gaggggccgacgggctcgcgcgcgcgccgtctgctgaggtccctcgggaaggaggagagcgcctgacgccgacccgcaggcgcagcccggcagtcggcggcgcgccgagggcggaggtggtgcgtgcgtgcgtgtgtgtgtgtgtgtgtgtgtgtgtgtgtgtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaa

SEQ ID NO: 6964 - DNA, 857 bp, Homo sapiens
cgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacaggcagatgtctctcagctatccctgtatagctccagtcctgttcatgttctctctcaccagcagtacatctgtgctgtgaggatgttaaggggatgagtgaagaggggtttgagagtgtcattaactggcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttaca

SEQ ID NO: 6965 - DNA, 1305 bp, Homo sapiens
agttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacaggcagatgtctctcagctatccctgtatagctccagtcctgttcatgttctctctcaccagcagtacatctgtgctgtgaggatgttaaggggatgagtgaagaggggtttgagagtgtcattaactggcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 6966 - DNA, 5522 bp, Homo sapiens
agaacgagtcgaacgtggaagtagggagcaggcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaatataaaatgttcaaggcttcttactgttgagcacaaggttacgtatttaaaatcacctagtatttgagagagatcctgcctatagcaccaagactcgaaggtaggctgctgctgtgcacatgagtttatacacaggaaattggaataacttggaatttctatgctggagactttggctacttctggatttcaagcattgtatgaagtgtgagaaaactgaggtgactagcacattaaaccatccagattctagcctccaggcacactaaatttaagtcttgataaaaccaggaggccatattatgatcataagtaagatgaagtttagccttccttttagtccattttgtattgccgtaaaggaatatctgaggctgggtaatttataaaaggtttgccgggtgcggtggctcacgcctgtaatcccagcactttgggaggctgaggcaggtggatcacgaggtcaggagattgagaccatcctggctaacacggtgaaaccccgtctctattaaaaatacaaaaaattagccaggtgtggtggcgagcacctgtagtcccaactactcgggaggctgaggcaggacaatggcgtgaacccgggaggtggagcttgcagtgagccgagatcacgccactgcactccagcctgggcaacagagcaagactccgtctcaaaaaaaaaaaaaaggtttatttggctcataattctggatgaccagaaagttgaagattgggtatctgcatctggtgagagcctcacgctgcttccactcatggtagaaggggaagaggcactatgtgtgtagagatcacatggccagagagtgagggtggaagtgccaggctttttttttttttttaaactagctttggtgggaactccctcacccctgctccccacaggaaggcattaatctatttatgagggatctacctgctataacccaaacaccccaccagcccccatctcccaacaccaccacactggggattaaatttcaatgtgggatttggagaggacaaatatccaaaccatagcagtcttaaagtatttaaattagaatttaaattaaaatttaaattacagtatttaaattagaatcatttgtggagtttctaaaaggtatgcattcctaggcccctctcaagttagatttatgaacactgatccccagtctgaattttaaaacagcaaaatctcatactggttctacagattattctgatgcacaatctgggttaagaaccactgtcctgtagtcgtgaagtctatatattttggtattttctttacctcttctctaattaaccagtctgaaggagtttgaattttggggatcgtacattgtctgcaagagaaacacattaacatccgtgcacatagagtcctttgtaataatttgggatgattgacttggtggctccaggtaggagagccagtcttcatgcaagttattcagtcactacagttttggaggactgactcttaaccccaataggaaatcagttgtgctattttaaattcataaagctattataaagagctgcctccagtaaaaaatacatatgccacatacccacaaacagcaatattaagccttcatttattgttggagttagaccttataatcaaaaagcaaattatttaagataaaattaccattgaggagtttaatacttttcaaggaatcttcacgtcagccttgatcccagaccaatagaatggaataacaacaggaatgttcagcatttctttgcagagagaaatccaaaagtttgtcctatgtgagattttgcttttcccatctttttgaagctgatcagcagatacataagaacctggaagaagctgctcaattaaggttaaaaaaaataaaaagcaattgttagcaatgtggtgctgaaatcaagacttaactttgaagtgtcaagaatgataacctcccatccacttcatgtgatttttaagaataaattttatatatttctccaggtattaaagtggatgtccacctttgccatttcagaacctaaaggcagaatctaatggtaaaatgaagacaacctagttgtcttctaataacctagttagttctaataacattctcaaatattttcatctagagtaaatatttactgttggctttgtattctgggaattagcccaagactatgctgctcaaatgggtgcaaatatactctcaggttgcaatagcatgacgagtggtatttgaagcaataattgttccatcttggattatcggttttgctctttgatttggtaaagtttttgtttttctactcgtgccagttgtattaaaatgtcactaggttaaaaacaaacacagatatgtttattcattactgtatccctgtaataatgcctggcatgcagtaggtccctaatatttgttgaatgaatgaattatagaatagagtgcaaaattaattctaatgtattttaaagtaaagcatgagagttcaaagaaatgttgtatttgccatctacaacttggaataatgttccttgatcctgctttacttcatgcacttttgccagcagaggtggatgccttagggaaaaagttggataaatgctgatctaaggcaacacgtctaaatggttatgtgaacatttcccagttggggtaaaactaagaggagtgataataacatctcatcaatttaaaggacaagttcactgatcgtactgtcatactccagagatacatgtgccaagaagcaaagagatgcactcttgtattccagaaagaagatgatttgtaagtgttcagtatttgtgtggcagcccttttaggtgtaatgaagtgtaacagaaaagtaagtgaactacttcacatagctcttaatgtttgtctttcagaggacatacgagtcaggcagcaaaagttggagccattgtatgattgtgtgtcaaaatgagagtcacacacttcaagaactgtaggaactaattttagaaaaagactcttcagaacagatgacacatgaaatgtgagtttatgtaaacatgtaaatttgagtagcattagtttgttttctgtttaggaactgtatcagggtgacaaagatgaaagaatgctgccagaaaagtatattgttaaattttcaggcctccattggtgaagtttcaagtaacctttcacttaagttacttgtgtcagaggatggatgatggggtcatttaaattgttggacaaagccatgaaaggacttttaaaattttgtcataaaaatagccaatgatgtttttaattttacatctaaaactaatttgcattatcctgtgttagtgactgaatctcaactcagtcctcattttttagttcaacttttgacaaccttatattcattgacaccatggacagcacagtaaaaaaatacacaaatttcttttgcagttattgatttggaatgatcactttaaaagagccatcaaatacgcctacatattgagccactctttatcattaaggtgaaaagttcattcaattaaggtatttgagtgctactatgcgccagcctttctttgtgataatgttaattttttttttcctcccctccatgaagggaagaaaaaaaaattaattcggccatgaattttaatattctggccagcaccttatccatttgtagccacgccaacaaatttattctgtgatataccaaacttacaaagtcactctgcgatttcagtaaggcccattcccaacatgagtgctgctgtccacggtactgaaccatcaatgctaaatggtatttagttgtggatcttcatcctgtcatgcagctaaatattccaggaatactgaaccaagtgaggagaaagatagcagtgggttgctgcaaaggaggtgaggggaggggagagatagcaagtgagaaaaagagagactagtggtgatgtttttaagtaattgaagtaaaaaagagagagaaagagagagagaagaggttctactcagtccaccaaagctttttaatttccttacataattaacatgatgaatttttaaataattgttatatttagttttgttcttccaccttttggctatttctactacatatttacttatcataaaaaatacttcctagaccttcctcttatagctattgcctatctctgcctttgcagctgttctcctttaaagagtagtctccattagttttcttgacttcttcatctccctgcataaagatgaagggtatttagctctgaaaatcctttactgttgaatatttagattgttttcaatttttacataatgaacaatgcatcatgggattattggctgcaaataaattggaaacataaaaggtgttttaagtttaaatttttttaaaaaaacaggtaaaaataaaatatttgccaaagactaa

SEQ ID NO: 6967 - DNA, 505 bp, Homo sapiens
ctaggactgggtactgataatttgctaataaggaaaagcatctgccttagaaagcatttcaataacttctgtgtgtattttcttgcagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttgg

SEQ ID NO: 6968 - DNA, 1427 bp, Homo sapiens
tggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaatataaaatgttcaaggcttcttactgttgagcacaaggttacgtatttaaaatcacctagtatttgagagagatcctgcctatagcaccaagactcgaaggtaggctgctgctgtgcacatgagtttatacacaggaaattggaataacttggaatttctatgctggagactttggctacttctggatttcaagcattgtatgaagtgtgagaaaactgaggtgactagcacattaaaccatccagattctagcctccaggcacactaaatttaagtcttgataaaaccaggaggccatattatgatcataagtaagatg

SEQ ID NO: 6969 - DNA, 581 bp, Homo sapiens
gggcaagagcaagggccacgatgacagattacggcgaggagcagcgcaacgagctggaggccctggagtccatctaccctgactccttcacagacatatgggacttgggattcagctccagctgagattgagagagcagaagattacttgtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaa

SEQ ID NO: 6970 - DNA, 1349 bp, Homo sapiens
ctgaggaactgcggctgcggttccgagcggggtctggggctgttaccattgagtgaccagaaaggctctcggtgcaaagcgttcctgcagaattgcttccacgtaaagggaccttcgggaaatttcgctggataccggctggcattgacaaacccagcgtccctgagccttgtgaggtttccaggcaggctgattgcgaggcaacatgtctgcttcggtgaaagaaagccttcagcttcagctactggagatggaaatgctgttttctatgtttcctaaccaaggagaagtaaaacttgaagatgtaaatgccctgacgaatataaagaggtatttggaaggcacaagggaggcgctgccaccaaaaatcgaatttgtaattacactccagattgaagagcccaaggtgaaaattgatttgcaagtgaccatgcctcacagctacccctatgtagcattgcagctgtttggacggtcatctgaacttgacagacatcagcagctacttctcaacaaaggtctcacttcttacatagggacttttgatccaggtgagctctgtgtatgtgcagcaatccagtggctacaggacaacagtgcatcttatttcctgaacagaaagcttgtatatgaaccatctacacaagcaaagccagtcaagaacacattcctccgaatgtggatctacagtcaccatatatatcagcaggacctaaggaaaaagattttggatgttgggaaaaggttagatgtgactggattttgcatgacaggaaagcctggtataatctgtgtggagggtttcaaagagcactgtgaggagttctggcacacaattaggtaccccaattggaagcacatttcctgtaagcatgctgaaagcgtggagacagaaggaaatggtgaggacctgcgccttttccattcttttgaagagttactccttgaggctcatggtgactatggattaaggaatgactatcacatgaatctgggccaattcttagaatttctcaagaagcacaaaagtgagcatgtttttcagatactatttggtattgaaagcaaaagttcagactcataaaaagcgattaagaggcctatgcctgtaatttcactaagtcagtatttctgttaataagaccaaattaaaaaggctagtggctgtgtagcatcctcagtgcaaaacccagctccagaattttcacctggtaacgaatttcaactgacagtgaaatgaataggcctttaaactttataacattgcaattgtgatgttatctctaggtttttgtgtgaagtcattcaaaaactatttcattgtaaattaataaaaacaatccatttaa

SEQ ID NO: 6971 - DNA, 2192 bp, Homo sapiens
aactgcggctgcggttccgagcggggtctggggctgttaccattgagtgaccagaaagggagaagtaaaacttgaagatgtaaatgccctgacgaatataaagaggtatttggaaggcacaagggaggcgctgccaccaaaaatcgaatttgtaattacactccagattgaagagcccaaggtaggtaccctgatttaagtgtttgccaggtgcccagtttttaattgaaacatctagaacatgagctttctgtcaaggaaagatagaaatattccaggtgcatatttccttgtttgaaagatacggaatgctctataaattgtcttcagtaaatatctttaattttatgtaaacatatacacctttttaacaaatatacctggagtttttattgacgctatcttgcagtcttatgccattattattttgttcacccatccagttggactacctttcacatgtatcatgattttcataaatctaaatatctcctgtaacataactgtcttttaaggagtgaatgagtggattttttgatggcaccataacacagaaagcaaatatggatggaaaaatctaaagactaaaaatgaatttacctccatcttctgatccatttatctccagcaacattagcatagcataggtaatacgtggactgggcatttgagaaccactgttgtagctatttcctactcatccttcagttgttattccctcagaggagactttctggttctccagactggattctgtcccgctggttacacacttcaatggaaccctccacttttccatggtaatgcttttcacaattgaaattaaatacttgctatatgtaattatttgtttaatgtgtgtctccttcactaggccctggacttcatgaagggcaaaaatagtgtctggtttattcacttttttatcccagcacaagggcacctggcacacgtagttgttcaataaatattgaaataatgcataaaaggaagcaatcatgtatgtaaagtacctggtacatttaatagtagcaataacatttctcaaaatcatgcagttgctattgataaactagcttatgtgatgttatggtatttaaatctatttgattttcattttaaggtgaaaattgatttgcaagtgaccatgcctcacagctacccctatgtagcattgcagctgtttggacggtcatctgaacttgacagacatcagcagctacttctcaacaaaggtctcacttcttacatagggacttttgatccaggtgagctctgtgtatgtgcagcaatccagtggctacaggacaacagtgcatcttatttcctgaacagaaagcttgtatatgaaccatctacacaagcaaagccagtcaagaacacattcctccgaatgtggatctacagtcaccatatatatcagcaggacctaaggaaaaagattttggatgttgggaaaaggttagatgtgactggattttgcatgacaggaaagcctggtataatctgtgtggagggtttcaaagagcactgtgaggagttctggcacacaattaggtaccccaattggaagcacatttcctgtaagcatgctgaaagcgtggagacagaaggaaatggtgaggacctgcgccttttccattcttttgaagagttactccttgaggctcatggtgactatggattaaggaatgactatcacatgaatctgggccaattcttagaatttctcaagaagcacaaaagtgagcatgtttttcagatactatttggtattgaaagcaaaagttcagactcataaaaagcgattaagaggcctatgcctgtaatttcactaagtcagtatttctgttaataagaccaaattaaaaaggctagtggctgtgtagcatcctcagtgcaaaacccagctccagaattttcacctggtaacgaatttcaactgacagtgaaatgaataggcctttaaactttataacattgcaattgtgatgttatctctaggtttttgtgtgaagtcattcaaaaactatttcattgtaaattaataaaaacaatccatttaacttgtgaagctgatttgattgaagaggaatccaaagcccataactaacatcaaaaatcaaactgcaattatgaattgagaaatatgaatagcatttgtttcacattgctagcacacatgtgacaca

SEQ ID NO: 6972 - DNA, 3094 bp, Homo sapiens
atgcgccgcatgctttttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacgaagggccaagagaaccacgaagatgccagttgccacattgttgagctgctgacccaacaccagccattgcctgtctctaaacatcttatgaaataaaaccagttttgtttaatttctaggctttttttttaaatagacggagtcttgctctgtcgcccgggctagagtgcaatggtgcaacctccgctcactgcaacctccgcctcccaagttcaagcgattctcctgcctcagcctcccaagtagctgagattacaggcgcccgccaccatgcctggctaatttttgtgttttttagtagagacagggtgtcaccattttggccaggctggtcttgaactcctgacctcaggtgatcctcccacctcggcttcccaatgtgcttggattacaggcataagccaccgtgcctggccaatatctaggctttttactagcagttgaaagctagtttgtcaaatagagtttttcagagctttagttttgcatttaccccagccttttgatacacaaataggtgaagtttttctgaagtggagtttgcagttccccactttttgtatactcacgctctgcccctgctcctgggcttgcctcagacaaggctgaggcattagtagggcttaaacttttttaacaagcctcaacaattcatcaaattagtaatttagaaaatttgtttggcaaattgtattctgacattttttgttctggaaatggctttctgtacatttatttttgccaaattgacctagcattaaataaacacaccacccagtttttgaggacctccataaaccagttagttccaaaagcatttattatttgctaatttgctagcatgcaggttgatgcaggttgataccaggtgttggatatttcttgaccagtcagacttggttaaggaatggagttggggtgagagacaatgcattaagttagtaaaaggttgtaggcaaactatgcttatcacaaaatgaatcagttagtaaaagacagcatatattatgtaatacaatgtagaaatctgaaggaataaaatggaagaaggcaatgtggatagatcttaaatataaaggtggttaaacataaatgagaatcagaatggtatttaaagcacagtgcttgtattggacctaaatcttatgtacgtccccagatttcctccctgctgccctgtcctatcgccccgtcagttgccctggaaatcccagttcctctgctgccaccagacagccaggtggaccagttgtgtgtctagtttctgattcctccagcgactaacagatttgtatgaaataccctacagagaatggaatctgacatccctaccaccaaagggggcagatgatgcatatattactttaagcagctaaagtggcagctaaactgctaaaactttttcagtctctctacattatattaaaaaccagattgctatgtataatatgcagatctcaaatgtcacataaacacatagaatgcaa

SEQ ID NO: 6973 - DNA, 2641 bp, Homo sapiens
gaactttacgccgctcctccaagcgtcagggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacagcga

SEQ ID NO: 6974 - DNA, 2590 bp, Homo sapiens
aggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacagcg

SEQ ID NO: 6975 - DNA, 3681 bp, Homo sapiens
gggaaccggaaggtgcggtggcactcacggaatctcgggtcttctgacgtgccgggcgggaagatgtcatcattgccaagaagagcgaaagtacaggtccaggatgtggtactgaaagatgaattttcttcattctctgagttatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctgaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacgggctgttgcaaagaaagttcatagtacaatccagaaaattaagaaggaagggaagatgtctgagtgcttgttaaaagccatgctgaattgtaaaacttttgaagaactagaacacgtgtctgctccatataaaactggaagcaaagggactaaagcccagagagcaagacagttgggcttagaaggagcagccagggcactgcttgagaaaccaggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 6976 - DNA, 1980 bp, Homo sapiens
agtttctgtcccaagctttattatttctgttaccttattcccttctccaccatgggtcttcctgtgtgtcaggattttttattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattc

SEQ ID NO: 6977 - DNA, 443 bp, Homo sapiens
ggcttggggtgcaggccagcccagactgagtattggctggaggatctgctttgggaagctttttgaaagcaaagatgaatatccctctaggtgagaaagtcatgttggacatagtcgcgatgtttcgccaatacagtggagatgatggtaggatggacatgccaggtctggtgaacttgatgaaggagaacttccccaacttcctcagtggctgtgaaaaaagcgacatggattacttgtccaatgcccttgagaaaaaagatgataataaggataagaaggttaattattctgagtttctttccttgctgggggatataaccatagaccaccacaagataatgcatggagtggcaccctgttccgggggaagccagtgatcccaccctacccaggggcctctggagacccccatggacaataaagcatctactcccacaaga

SEQ ID NO: 6978 - DNA, 480 bp, Homo sapiens
gggaagagccaggccgagccttataaagggactgctctttgtccaaacacacacatctcactcatccttcttctcgtgatgcttcccagctctggctttttgaaagcaaagatgaatatccctctaggtgagaaagtcatgttggacatagtcgcgatgtttcgccaatacagtggagatgatggtaggatggacatgccaggtctggtgaacttgatgaaggagaacttccccaacttcctcagtggctgtgaaaaaagcgacatggattacttgtccaatgcccttgagaaaaaagatgataataaggataagaaggttaattattctgagtttctttccttgctgggggatataaccatagaccaccacaagataatgcatggagtggcaccctgttccgggggaagccagtgatcccaccctacccaggggcctctggagacccccatggacaataaagcatctactcccacaaga

SEQ ID NO: 6979 - DNA, 480 bp, Homo sapiens; identical to SEQ ID NO: 6978

SEQ ID NO: 6980 - DNA, 2880 bp, Homo sapiens
cataagcagaggaatgcagaaccttctcacccagcgggatgaaatcatgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcattctaccgtcactcacaatatccgtgaagagagaatggaaaatggccaaccccaacctgataacgtcttgtcaactggtcccacagggcttattaatatggcagcaactcctattccagccatgagtgccagagatctctatgctacagtcactcacaatgtctgtgaacagaagatggaaaatgtccaaccagcacctgataacgtgttgttgactcttcgaccacggcgtattaatatgacagacactggtatttcacccatgagtaccagggatccatatgctaccatcacttacaatgtccctgaggagaagatggaaaagggccaaccccaacctgataacatcttgtcaactgcttcaacagggcttattaatgtggcaggagctggtactccagccatcagcaccaatggcctgtattccaccgtccctcacaatgtctgtgaagagaagatggaaaatgaccaaccgcaacctaataacgtattgtcaactgttcaaccagtgattatttatttgacagcaactggtattccgggcatgaataccagggatcagtatgctaccatcactcacaatgtctgtgaagagagagtggtaaataaccaaccactacctagtaacgccttgtcaactgttctaccagggcttgcttatttggcaacagctgatatgccagccatgagtaccagggatcagcatgctaccatcattcacaatctgcgtgaagagaagaaagataacagccaaccaacccctgataacgtcttgtcagctgttacaccagagcttattaacttggcaggagctggtattccacccatgagtaccagggatcagtatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaa

SEQ ID NO: 6981 - DNA, 2879 bp, Homo sapiens
atgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcattctaccgtcactcacaatatccgtgaagagagaatggaaaatggccaaccccaacctgataacgtcttgtcaactggtcccacagggcttattaatatggcagcaactcctattccagccatgagtgccagagatctctatgctacagtcactcacaatgtctgtgaacagaagatggaaaatgtccaaccagcacctgataacgtgttgttgactcttcgaccacggcgtattaatatgacagacactggtatttcacccatgagtaccagggatccatatgctaccatcacttacaatgtccctgaggagaagatggaaaagggccaaccccaacctgataacatcttgtcaactgcttcaacagggcttattaatgtggcaggagctggtactccagccatcagcaccaatggcctgtattccaccgtccctcacaatgtctgtgaagagaagatggaaaatgaccaaccgcaacctaataacgtattgtcaactgttcaaccagtgattatttatttgacagcaactggtattccgggcatgaataccagggatcagtatgctaccatcactcacaatgtctgtgaagagagagtggtaaataaccaaccactacctagtaacgccttgtcaactgttctaccagggcttgcttatttggcaacagctgatatgccagccatgagtaccagggatcagcatgctaccatcattcacaatctgcgtgaagagaagaaagataacagccaaccaacccctgataacgtcttgtcagctgttacaccagagcttattaacttggcaggagctggtattccacccatgagtaccagggatcagtatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgca

SEQ ID NO: 6982 - DNA, 3045 bp, Homo sapiens
caggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacagatgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcattctaccgtcactcacaatatccgtgaagagagaatggaaaatggccaaccccaacctgataacgtcttgtcaactggtcccacagggcttattaatatggcagcaactcctattccagccatgagtgccagagatctctatgctacagtcactcacaatgtctgtgaacagaagatggaaaatgtccaaccagcacctgataacgtgttgttgactcttcgaccacggcgtattaatatgacagacactggtatttcacccatgagtaccagggatccatatgctaccatcacttacaatgtccctgaggagaagatggaaaagggccaaccccaacctgataacatcttgtcaactgcttcaacagggcttattaatgtggcaggagctggtactccagccatcagcaccaatggcctgtattccaccgtccctcacaatgtctgtgaagagaagatggaaaatgaccaaccgcaacctaataacgtattgtcaactgttcaaccagtgattatttatttgacagcaactggtattccgggcatgaataccagggatcagtatgctaccatcactcacaatgtctgtgaagagagagtggtaaataaccaaccactacctagtaacgccttgtcaactgttctaccagggcttgcttatttggcaacagctgatatgccagccatgagtaccagggatcagcatgctaccatcattcacaatctgcgtgaagagaagaaagataacagccaaccaacccctgataacgtcttgtcagctgttacaccagagcttattaacttggcaggagctggtattccacccatgagtaccagggatcagtatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgc

SEQ ID NO: 6983 - DNA, 1754 bp, Homo sapiens
ggcagaggcagaggaacacagaaccttctcacacagcgggataaaaggatgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaa

SEQ ID NO: 6984 - DNA, 3045 bp, Homo sapiens; identical to SEQ ID NO: 6982

SEQ ID NO: 6985 - DNA, 225 bp, Homo sapiens
agaggatcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaa

SEQ ID NO: 6986 - DNA, 3000 bp, Homo sapiens
gagcgtggctcaccgggcccggccggaacctacgggcacagctgcgggtgtgtctgcggaacctccacctgagctgtagagtgtttccctcgacccactagtctgggttccacagggtctgagctcctcagaggtgggagctgcggccgagggaagggtgcatgtgcgcggcgacaatcgggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgcctagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttgcggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaagaggaaacatgatgagattcaaagaagtttgcctgttaaaccttccaaaatgctaaagccatcagggacaccattttcaccagacaaagtaggagactggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattc

SEQ ID NO: 6987 - DNA, 2383 bp, Homo sapiens
tttgtaacttcacttcagcctcccattgatcgctttctgcaaccattcagactgatctcgggctcctatttcatttacattgtgtgcacaccaagtaaccagtgggaaaactttagagggtacttaaaccccagaaaattctgaaaccgggctcttgagccgctatcctcgggcctgctcccaccctgtggagtgcactttcgttttcaataaatctctgcttttgttgcttcattctttccttgctttgtttgtgtgtttgtccagttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggagtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatacgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaa

SEQ ID NO: 6988 - DNA, 2539 bp, Homo sapiens
gagggccggaaaacagaaaaggattcgcgttctttttactctgtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggagccatctctagaatgtcaaatggtctctcttcaactggaatgatgagaagtgaaacaaatatgcgaccatgaggacactgtaacctatggatggtgtgctgagactggaaacccaaaatgatgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggagtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatacgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaactgggaaaa

SEQ ID NO: 6989 - DNA, 451 bp, Homo sapiens
ggggagggccggaaaacagaaaaggattcgcgttctttttactctgtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttc

SEQ ID NO: 6990 - DNA, 702 bp, Homo sapiens
gagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggaggttttcgatgtttgcatgcagccatctctagaatgtcaaatggtctctcttcaactggaatgatgagaagtgaaacaaatatgcgaccatgaggacactgtaacctatggatggtgtgctgagactggaaacccaaaatgatgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagtt

SEQ ID NO: 6991 - DNA, 685 bp, Homo sapiens
ctttttactctgtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaa

SEQ ID NO: 6992 - DNA, 2294 bp, Homo sapiens
gtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggagtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatacgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttg

SEQ ID NO: 6993 - DNA, 2752 bp, Homo sapiens
acatattccccccttgaggctagaatggcaggcctaaaatgagtaggagaattctgagaaatggaaactttaaaaaggcggcaaccttctagtttcattctcagaaataccaaagcagcatttttcctggacttgttctgcagagcgctcagatttgaaagccatttctagcctttgaggattaccactgtcctcagccaaactgcagggactcctaagtagatcagagctcctggaactttctcatcttttcagcatctcaaccctgtggaatcttttaactcccaagtgctaccaggatatttgcgatgtactctggaatccctctggaaggagctgtcctcacagaatgaaggattagaggagttaataaataagcaaacccaacctttctcctggggaattgtgatcctctctagaagctaggctgtggacctgaatttgcaggagaagccaggagtcatctgtgatgctctgctgatagcatagaacagccctggcagggccaggactactgcacttgcactgcccttactttgaagcagaagctggtgaacatggggggctacactggggaggtgtgtgtcagggccaaggtcctctgcctgagtcctgagagcagcgcagaggctttggaggctgcagtgtctccgatggattaccctgcgtcctatagttttgcaggcacccagcacattggaagccctgctgcagtccctcgtgattgtcttgctcggcttcaggtctctcttgagtgacctgtgcagctatgaggttttaaatctgctcacagcccagcagtatgagatattctccagaagcttccacaagaacagagaattgtttgtccatggcttacctggcttaggaaagaccatcatggccatgaagatcatggagaagatcaggaatgtgtttcactgtgaggcacacagaattctctacatttgtgaaagtcagtttctgaggaatttcatcagaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccagtatgtgaggaactgccctctccagcaagtacatcatcacctgtctcccagagttatcctcttcgtgaatatattaacttcaaaattcagccactgagatatcaccttccagggctatcagaaaagataacttgtgctccaaaaaccttctgcagaaatctgttctcacaacatgaaggacttaagcaattaatatgtgaagaaatgggctctgtcaataagggctcactgatcttctctaggagctggtctttggatctgggcttgcaagagaaccacaaagtcctctgtgatgctcttctgatttcccaggacaagcctccagtcctatacaccttccacatggtacaggatgaggagtttaaagactattctacacaaactgcccaaactttaaaacagaagctggcaaaaattggtggttacactaaaaaagtgtgtgtcatgacaaagatcttctacttgagccctgaaggcaagacaagctgccagtatgatttaaactcgcaagtaatttaccctgaatcctactattggacaacagctcaaacaatgaaagacttggaaaaggccctttcaaatatcttacctaaggagaatcaaatctttttgtttgtttgtttgtttcgtttttgtttgtttgtttgttggtttgtttgttttttcttgagatgagtctcactctgtcacccag

SEQ ID NO: 6994 - DNA, 1876 bp, Homo sapiens
atgcagctgagcgaggggctagccgcacacacgcggagagcaggaaagtggaaaagaactcaggtccccctacttggtgaagagtgcgcagacatggacctcgccagaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccagtatgtgaggaactgccctctccagcaagtacatcatcacctgtctcccagagttatcctcttcgtgaatatattaacttcaaaattcagccactgagatatcaccttccagggctatcagaaaagataacttgtgctccaaaaaccttctgcagaaatctgttctcacaacatgaaggacttaagcaattaatatgtgaagaaatgggctctgtcaataagggctcactgatcttctctaggagctggtctttggatctgggcttgcaagagaaccacaaagtcctctgtgatgctcttctgatttcccaggacaagcctccagtcctatacaccttccacatggtacaggatgaggagtttaaagactattctacacaaactgcccaaactttaaaacagaagctggcaaaaattggtggttacactaaaaaagtgtgtgtcatgacaaagatcttctacttgagccctgaaggcaagacaagctgccagtatgatttaaactcgcaagtaatttaccctgaatcctactattggacaacagctcaaacaatgaaagacttggaaaaggccctttcaaatatcttacctaaggagaatcaaatctttttgtttgtttgtttgtttcgtttttgtttgtttgtttgttggtttgtttgttttttcttgagatgagtctcactctgtcacc

SEQ ID NO: 6995 - DNA, 8469 bp, Homo sapiens
atcccctgtgtgggacctgcccaggtaggcgccaaccattggttataagaacctgaccttggcgcctccagggaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtcacatcttttgtttcacgaattaacagtcaacacctggccctacttttaacaaaacttagtaaagccttgagcatagtgaaagacaaatatttaaattatatattagcaggaggctgaggtgggaggatcatatgaggccagcctgggcagcatagcatgacccccccctcgagaagacaacaaaaaattatctgggtgtggtggtgtgctcctgcagtcctagctattccagaggccgaggcgagaggatcgcttgattccaggagttcaaggctgtagttagcgataatcgtgtcactgaatcctagcctgggcaacagaataagaccccatgtctaacaaaataataataaaacaatcaaaagtttaaaattagttattaaatgtcagtgtgcccagagtcctttgaccacagatgatcctgatggccttctctcgccttgtccctgtgcctccttctaccatttttcttcctgagattcaaaagtaagtagcggacagggttcccatttaccactaaatacttcagtgggtgtttcctaaaaggacatttatagtaccatcatcaaaatcagtaaattaaccctgatactattatctaatctgtagactttattgaattatatcagttgtgcctcaagtgtctttatgtttttttctcaaaagagaaaaagttctggtccaggatttgatctaagatcatgcattgtattgagctttcctttcttttaagtctcatttaatctggagatgttaatctgtctttgtcatatctttgacactattgaagaggactggcctattattttgcagagtatctgattttgggtcatttcatgtgttctcatgattagattcaggttatgcatttttggcatgaattccatagaagggctgttacggttctcagttcacggtattagaaggcacttgatagtgattagttccattcctgatgatgttaactctgatcatttggataaagtggcgtctgccaggtttccctactgtgcagttacaatttgctttttgtaattaataaagtgtgtgtgtgtgtgtgtgtggagggggggtgtttttgcttctgaacgcataatatttgagatttttttctaattaaaaagtaattattcaaagagttcagagaactgatactgatcacattctttgaccccacatgcaaatacattataaactagtaataaaacggtaactagaaaaatgttcatatcttttggaattaaaaaagtgtttaactcgtggatcaaagcagaaattctgtaaccattgtcacagcaggttctaacaagcaagtttaaggaggagagaatttcagtcctagagaatttcagtcttattcaaatgctttcctagaaagaggaaacagttcctaactaatttcatgaggctggcataatcttgataacaagtctgataggtaaagtatgaaaggaaaattgcaggtcactcaattatcactcaaatatctacatgaaaaattctaaacaaaattttagcaaacaaaatccaacaatttgtaaaagtgataatacaccacgaccaaggtggttcaagtcaggaattcaacgttgattttggcgttaaaaaatcaatcatcaggcccagtgaggtggctcactcctgtaatcccagactttctggaggctgaaggaggaaagatccttcaggccagaagtttgagtctgcactgagctgtgactgcatcaccgcactctagcctgggtgccagtttgagaccctgtctccaagaaaaaaaaattaatcagtgtaattcaccacagattaagagttcaaaagagaaaaatcacatgatcatctgaatagaggaaaaagcttttgataaagttcaacatccattcataataaggactctcagcaacttagaagtataaaaacacttttggaaatcaacaaagggaatttacagcatgaacaaacagcaagccagcatggtggctcacacctgtaatctcagcacttccagaggccaaggcaggagaatcacttgagcccaggggttagagacaagccttggcaacatagcaagatcctggctctacaaaaaataaaataaaatgaaataaaatttaaaaattagctgggtttggtggtgtgtgcctgtagtcccagctactgggaggctgaggtgagaggatcactggagcccaggaggtgaaggctgcagtgggctaaaaacaaccagaacaaccccccaaccccctccccgcaaaacactataaagaatagcaacacaaggttcaatgtaaactttgatatggtgttttacctctgaggagaggcttattgttaatattctttagccgtgtaaggggttcacagatgttcatacttttgttctttataccttatatgtattctataaatattgtttctactcaatagttaataaaaacataatttaaaagttc

SEQ ID NO: 6996 - DNA, 7239 bp, Homo sapiens
atggaggcaaatcactgctccctggctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtcacatcttttgtttcacgaattaacagtcaacacctggccctacttttaacaaaacttagtaaagccttgagcatagtgaaagacaaatatttaaattatatattagcaggaggctgaggtgggaggatcatatgaggccagcctgggcagcatagcatgacccccccctcgagaagacaacaaaaaattatctgggtgtggtggtgtgctcctgcagtcctagctattccagaggccgaggcgagaggatcgcttgattccaggagttcaaggctgtagttagcgataatcgtgtcactgaatcctagcctgggcaacagaataagaccccatgtctaacaaaataataataaaacaatcaaaagtttaaaattagttattaaatgtcagtgtgcccagagtcctttgaccacagatgatcctgatggccttctctcgccttgtccctgtgcctccttctaccatttttcttcctgagattcaaaagtaagtagcggacagggttcccatttaccactaaatacttcagtgggtgtttcctaaaaggacatttatagtaccatcatcaaaatcagtaaattaaccctgatactattatctaatctgtagactttattgaattatatcagttgtgcctcaagtgtctttatgtttttttctcaaaagagaaaaagttctggtccaggatttgatctaagatcatgcattgtattgagctttcctttcttttaagtctcatttaatctggagatgttaatctgtctttgtcatatctttgacactattgaagaggactggcctattattttgcagagtatctgattttgggtcatttcatgtgttctcatgattagattcaggttatgcatttttggcatgaattccatagaagggctgttacggttctcagttcacggtattagaaggcacttgatagtgattagttccattcctgatgatgttaactctgatcatttggataaagtggcgtctgccaggtttccctactgtgcagttacaatttgctttttgtaattaataaagtgtgtgtgtgtgtgtgtgtggagggggggtgtttttgcttctgaacgcataatatttgagatttttttctaattaaaaagtaattattcaaagagttcagagaactgatactgatcacattctttgaccccacatgcaaatacattataaactagtaataaaacggtaactagaaaaatgttcatatcttttggaattaaaaaagtgtttaactcgtggatcaaagcagaaattctgtaaccattgtcacagcaggttctaacaagcaagtttaaggaggagagaatttcagtcctagagaatttcagtcttattcaaatgctttcctagaaagaggaaacagttcctaactaatttcatgaggctggcataatcttgataacaagtctgataggtaaagtatgaaaggaaaattgcaggtcactcaattatcactcaaatatctacatgaaaaattctaaacaaaattttagcaaacaaaatccaacaatttgtaaaagtgataatacaccacgaccaaggtggttcaagtcaggaattcaacgttgattttggcgttaaaaaatcaatcatcaggcccagtgaggtggctcactcctgtaatcccagactttctggaggctgaaggaggaaagatccttcaggccagaagtttgagtctgcactgagctgtgactgcatcaccgcactctagcctgggtgccagtttgagaccctgtctccaagaaaaaaaaattaatcagtgtaattcaccacagattaagagttcaaaagagaaaaatcacatgatcatctgaatagaggaaaaagcttttgataaagttcaacatccattcataataaggactctcagcaacttagaagtataaaaacacttttggaaatcaacaaagggaatttacagcatgaacaaacagcaagccagcatggtggctcacacctgtaatctcagcacttccagaggccaaggcaggagaatcacttgagcccaggggttagagacaagccttggcaacatagcaagatcctggctctacaaaaaataaaataaaatgaaataaaatttaaaaattagctgggtttggtggtgtgtgcctgtagtcccagctactgggaggctgaggtgagaggatcactggagcccaggaggtgaaggctgcagtgggctaaaaacaaccagaacaaccccccaaccccctccccgcaaaacactataaagaatagcaacacaaggttcaatgtaaactttgatatggtgttttacctctgaggagaggcttattgttaatattctttagccgtgtaaggggttcacagatgttcatacttttgttctttataccttatatgtattctataaatattgtttctactcaatagttaataaaaacataatttaaaagttc

SEQ ID NO: 6997 - DNA, 576 bp, Homo sapiens
aaaacagaaagcccctgcccagcgagcagcggtttccgcgggggcggaacaaacaggcagagccaagtgcgtcctggaggcttcccccgttgcgaaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttata

SEQ ID NO: 6998 - DNA, 6004 bp, Homo sapiens
accttggcgcctccagggaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtacttcaggactgattttggtgtaagaagacagcaggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtcaca

SEQ ID NO: 6999 - DNA, 3058 bp, Homo sapiens
aaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctggctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaa

SEQ ID NO: 7000 - DNA, 5921 bp, Homo sapiens
gtggaagaagacagcaggcggtgggcattcactgtgctggtgggaagtctggttacattaagaaaggaattctagcaaagttattctgtaaatacaacagaatcagttgcttttgttaaatatattggtacttcaggactgattttggtgtaagaagacagcaggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtca

SEQ ID NO: 7001 - DNA, 2882 bp, Homo sapiens
attgtttggagcacagaggggctgctgaaatggagagtctcaagactgatactgaaatgccgtatcctgaggtaatagtagatgtgggcagagtgatttttggagaagaaaacaggaagaagatgaccaacagctgtttgaaaagatctgagaattctagaattatccgggctatatgtgcactgttaaattctggaggtggtgtgatcaaagcagagattgatgataaaacctatagttaccaatgccatgggctgggacaggatttggaaacttcttttcaaaagctccttccttcaggttcacagaaataccttgactacatgcagcaggggcacaatctcctgatttttgtgaagtcatggagcccagatgttttcagccttccactaaggatttgcagcttgcgctccaatttgtatcggagagatgtgacttctgctatcaacttgagtgctagcagtgccctggagcttctcagagagaaggggtttagagcccaaagaggaagaccaagggtgaagaagttgcatcctcagcaggttctcaatagatgcattcaggaagaggaagatatgaggatattggcctcagaattttttaaaaaggacaaactcatgtataaggagaaactcaactttactgagtcaacacatgttgaatttaaaaggttcaccaccaaaaaagtcatacctcggattaaggaaatgctgcctcattatgtttctgcatttgccaacactcaagggggatatgtcctcattggggtggatgataagagcaaagaagtggttggatgtaagtgggaaaaagtgaatcctgacttactaaaaaaagaaatcgaaaactgcatagaaaaattgcctacattccacttctgctgtgagaagccaaaggtaaatttcactacaaaaatcctgaatgtgtaccaaaaagatgtcctggatggttatgtctgtgtgattcaagtggagcccttctgttgcgtggtgtttgcagaggccccagattcctggatcatgaaagacaattctgtcacacggctgacagctgagcagtgggtggtcatgatgctggatactcagtcagctcctcccagtttggtcacagactacaactcttgcctgatttcatcagcttcatctgcacgaaaaagtcccggatatcccataaaagtccacaaatttaaggaggctctgcaacgacatttgtttccagtgacacaggaagaggtacaatttaaaccagaatccctctgtaagaagctgttctcagatcataaagaactggagggtttaatgaagaccctgatacatccttgttctcaggggattgtgatattttctagaagctgggctggtgatgttggcttcaggaaagaacagaatgtcctgtgtgatgctctcctgatagcagttaacagccccgtggtactctatacaatcttaatagaccccaattggcctggaggacttgaatatgcccgaaacacagctcatcagttaaagcagaaactgcaaactgttggtggttacacagggaaagtgtgcatcattccaaggctgatacacctgagcagcacacagagtagacctggtgagatccccctgcgttaccccaggtcctacaggcttgctgatgaggaggaaatggaagacttgctgcaggctctggtggtggtctccctgtcctccagatctcttctgagtgaccagatgggctgtgaatttttcaacttgctcataatggagcagagccagttgctttctgagagtcttcagaagacacgtgaattattcatctactgctttccaggagtcaggaagacagccctagccataaagatcatggagaaaattaaggacttgtttcactgcaaaccaaaagagatcctctatgtttgtgaaagcgactccctaaaggattttgtgacccaacaaaccacctgccaagctgtgaccaggaaaactttcatgcaaggggagtttctaaagattaaacacatagtgatggatgagactgagaatttctgcagcaaatatggcaattggtacatgaaggctaagaacatcacccatccaaaggcgaaggggactggaagtgaaaaccttcaccatgggattctctggctttttcttgacccttttcaaatccatcacgcagatgtcaatggccttccccctccatctgctcagtttcctcgaaaaacaatcaccagtgggatccactgtgctctggaaatagcgaaggttatgaaagaagaaatgaagaggatcaaagaaaatcctccctccaacatgtctccagacacattagcattgttcagcgagactgcctatgaggaagcaacgtgtgcccaggctctgcctggggtgtgtgagacaaagactaatctgacaacagaacaaatagctaactatgtggcaagaaaatgtcacagcctgttccagtgtggctatctgcccaaagatatagcaattctgtgcaggagaggggaggacagaggacgctataggcttgcactactcaaagcaatggaattaattgagacccacagaccatcagaggttgtgtttagcccggccaccggtgtttggggaagtcacattgttttagacagtattcagcaattttcaggcctggagaggactgtcgtgtttgggcttagtccagaatgtgaccagtcagaggaatttcataagctctgctttgcttcaagagccattaaacacctctacctgctttatgaaaagagggcagcctactgaaaattattacaaataatagaggaagacaggaagagcagagtcctttctcctagacaggtagcagtgactccattttaatattacaagtgaggaaatcaaggcacatcagtatgg

SEQ ID NO: 7002 - DNA, 4625 bp, Homo sapiens
aggttctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttccagtattttcagacagagtggtatatactccagaaagcctctacaaggaactcttctcacaacataaaggactcagagacttaataaatacagaaatgcgccctttctctcaaggaatattgattttttctcaaagctgggctgtggatttaggtctgcaagagaagcagggagtcatctgtgatgctcttctaatttcccagaacaacacccctattctctacaccatcttcagcaagtgggatgcggggtgcaagggctattctatgatagttgcctattctttgaagcagaagctggtgaacaaaggcggctacactgggaggttatgcatcacccccttggtctgtgtgctgaattctgatagaaaagcacagagcgtttacagttcgtatttacaaatttaccctgaatcctataacttcatgaccccccagcacatggaagccctgttacagtccctcgtgatagtcttgcttgggttcaaatccttcttaagtgaagagctgggctctgaggttttgaacctactgacaaataaacagtatgagttgctttcaaagaaccttcgcaagaccagagagttgtttgttcatggcttacctggatcagggaagactatcttggctcttaggatcatggagaagatcaggaatgtgtttcactgtgaaccggctaacattctctacatctgtgaaaaccagcccctgaagaagttggtgagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaacagagtggtccgcaatgcaggtccaatagctaattacctacaacaagtaatgcaggaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagcgagaatgtgaaggatggagcaggtagctcatctggccttgtaggtgccgggaacgggcaagacatgttttgaaatgtaagatcacagactgttttttgcaagaccacattatattactttattattttctgctttttcttttaacgacattagtgtttttgatcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctagaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattagtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctcc

SEQ ID NO: 7003 - DNA, 2540 bp, Homo sapiens
tctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttccagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaacagagtggtccgcaatgcaggtccaatagctaattacctacaacaagtaatgcaggaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagc

SEQ ID NO: 7004 - DNA, 1951 bp, Homo sapiens
gttccctgagagctaccggccaggggtcgggaggctatgggagctcagggcaggcacctcccatgctcccgcgggagccaccaggacatgaaggtcataggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 7005 - DNA, 4310 bp, Homo sapiens
gaacccaccactccaagctgcctgcagagcacctatactttctaatactattacctaatactagagagccagagacaccgtaaataaccttgttatcttatatttatgtatttaaaagatggttcataaatgtgtttagtgcttaccatgaaagacaatttttacccccatctccaaaaagaagtagaactgattcagctcacagaaggctgttaaaggcgccagagaaatatgtgatgcagtggcttaaagagactgccaggaagagtggggaaagttgctgcactcaagtcaatttgggaaatttcatgcagaacagccacccaatagcaaggcctctaggtaagtagggagaacgcctctggtcatgttcaggtgtttcgtctgtcaaggtgcttctcccggacagctatttctgcacagttcaacacgacttgagttggccatctcaaaacagctatagcctcagttgctgtgagggcacctcatggatgacagaggcaagaaaggcttgagggagagggggtgaggcagggggagcttggagccgtcattctctaaccctaagagctgtggacacaaagccgagcccaacctggctgctgcccgggcgggcaaggagagggcaccgaatgcactctccccagagcctcgcactgccaccagttgaggcctgcgcccctctcttccccgcacaccatagcctcttttcttgagtgctctacccaaactactgcctcaccccctaggaaacaaacatttggtaacatcttcagaaaggctgctttcaaggaaggcagcttctctacgctgtcaaacagctttcttagttgaagcatctaactgtggcaccatccttactgcccccaattggggcttccagaagcagtgtgggcaagcgctgccagccttctgcagaatgatgagcactggtcagtcctgtgctgataaagactgtgtgtcacccacgtcttggtttctccaacagcaggtaacaacctcatcttcccaaagagatagatagctacgcctgacctatttttcagggctcttctggacagcagcctctgtctccagcacagagaagggcctggcgtcagggggagccctggagcctaccatgtgcctcctgctccatcttgggagcagctgggccctgtcagtactcagtagagcctgggattggtgactgactaaagagggaggtggaggctttaggcagcagcgctgaaagaggtggcaagaggtgacctgcatgggaactggggcctgaagagacatcactaagtggggaagtgtgtcccacagccaagctgcatggtgggtgggccgctgggtctgcttccagtgtgtggtgggacccacagggagctgagttttcctgtttgatttcccgcacccagcctgcctgtggctggccaagaaggcattgttgaacctcatgagatcacagaggtagctgtgcaggccccgcccacttcctataaccctggttctggccgtccctgtgccaagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatggggttttagagcaggcagagaagctgcaatggggccaccagccagtcctcagagtcctgggttaaggcctcctctccaggaggccctgtgtaaaggttttctctgttgcctggaggcaggagtgaactggtaggcaggaaaccctgagggtacctaggaggcccctagcctgtgggttggggagggaagacaggacccctggggccactgaaatggtggagctctcagagacctgagttctggtcccttctgccactttttgggcagatcccgtcttcccacaggccctgtgtcttgctcagtccacgtgactctgctttctcatcctaggcctcaggtgggtggcaggccctttcctgcttgccctctgccctccctctctctggccctgcccagtctctgccaatctgtgtacctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 7006 - DNA, 1865 bp, Homo sapiens
tctggccgtccctgtgccaagcctccaagttccctgagagctaccggccaggggtcgggaggctatgggagctcagggcaggcacctcccatgctcccgcgggagccaccaggacatgaagatcccgtcttcccacaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 7007 - DNA, 2654 bp, Homo sapiens
aagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatggggttttagagcaggcagagaagctgcaatggggccaccagccagtcctcagagtcctgggttaaggcctcctctccaggaggccctgtgtaaaggttttctctgttgcctggaggcaggagtgaactggtaggcaggaaaccctgagggtacctaggaggcccctagcctgtgggttggggagggaagacaggacccctggggccactgaaatggtggagctctcagagacctgagttctggtcccttctgccactttttgggcagatcccgtcttcccacaggccctgtgtcttgctcagtccacgtgactctgctttctcatcctaggcctcaggtgggtggcaggccctttcctgcttgccctctgccctccctctctctggccctgcccagtctctgccaatctgtgtacctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 7008 - DNA, 1973 bp, Homo sapiens
aagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctggatcccgtcttcccacaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 7009 - DNA, 2117 bp, Homo sapiens
aagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctggatcccgtcttcccacaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 7010 - DNA, 2221 bp, Homo sapiens
agaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattctt

SEQ ID NO: 7011 - DNA, 3176 bp, Homo sapiens
tcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctgtttgtgatcttcctgattccacctacaagttcattagttctaaataaaagcctgttggcaagtgttggtagattacaactctttttatttgaagttgctcgagaagttagacatgctttagaattatgagtgtggggaaaatttgatgttccttaggattatataactgaggagggaacattgcaaatagggtctgaggctttgtttctctcttgctctgaaacatttctgaaaaggcaaggaagggaggggtagtgtctggggcagtgctggtagcctgcatgtgttgtaaatcatcctgccataacaaaggactgcattgttctagctggcccactgggcaggtctgccaggctacttggaactgtagtgggaaggtggttgattggagggttatctgtatataaaaggttttctcccctccaaagaaagactccagtacaagatacctggtcccagggagtctaaattgtaacagcaacccctgtggactttgtgggtatgagttttgattgaaatataaagctttcttttctgtaagtttaagttttccatctgaccatagcagaaaaacctagacccacctagtgaaactttgtaagaactccagggcaaaaacgaaccacttgcaacccacatgtttgtaggtgtatggtcgatggaagtttctggcatccatgttggtaataaagagataaaactgaaaa

SEQ ID NO: 7012 - DNA, 1117 bp, Homo sapiens
ctcggaaccggaagtggagcctgggagccttgacgttaggaacgaagtctaacctggatctggagccgggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctgcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaa

SEQ ID NO: 7013 - DNA, 1565 bp, Homo sapiens
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttctcttcagtg

SEQ ID NO: 7014 - DNA, 1832 bp, Homo sapiens
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgggactctggaaatatgaaggaactagggagtggaagagatttcagagctggggagaggagttcctcccttcaaagccagcaactgcctttggggaatgtcggggggtatctcctttctcctgcttgtgtgaggtggtacacagtccccccttcacctggcgggaagcctgtcccggacagactcatctcagctttcccttggggcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttctcttcagtg

SEQ ID NO: 7015 - DNA, 3037 bp, Homo sapiens
ttccggcaactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcc

SEQ ID NO: 7016 - DNA, 548 bp, Homo sapiens
gtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcag

SEQ ID NO: 7017 - DNA, 839 bp, Homo sapiens
gggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacgttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaa

SEQ ID NO: 7018 - DNA, 582 bp, Homo sapiens
aactgatgcctccactggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacggtactggcgccgaaagacgttcaataaatacttattgaatgacgaatacgcgttaggagttgttaaaaaaaatggaacctttttcctgtgacactttcgtgg

SEQ ID NO: 7019 - DNA, 804 bp, Homo sapiens
cagcttccggcaactgatgcctccactggccactcctccctccgtccacctgtcacttcgggtagctgggaggccagcaaaataaggacctttaggtgttctattataagtgaagatctaagattttccaagttacaactgaagagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaa

SEQ ID NO: 7020 - DNA, 718 bp, Homo sapiens
tttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaa

SEQ ID NO: 7021 - DNA, 1788 bp, Homo sapiens
ttccggcaactgatgcctccactggccactcctccctccgtccacctgtcacttcgggtagctgggaggccagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgc

SEQ ID NO: 7022 - DNA, 6779 bp, Homo sapiens
aatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacaacccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatg

SEQ ID NO: 7023 - DNA, 7176 bp, Homo sapiens
atttctaactacgcctccagcccattcgggccctcctcggcttccgtcccagatgatccctccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacaacccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 7024 - DNA, 433 bp, Homo sapiens
cagctcctgagactgccggcatgaaggggagccgtgccctcctgctggtggccctcaccctgttctgcatctgccggatggccacgggggaggacaacgatgagtttttcatggacttcctgcaaacactactggtggggaccccagaggagctctatgaggggaccttgggcaagtacaatgtcaacgaagatgccaaggcagcaatgactgaactcaagtcctgcagagatggcctgcagccaatgcacaaggcggagctggtcaagctgctggtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccgca

SEQ ID NO: 7025 - DNA, 1196 bp, Homo sapiens
ggttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagagacagggtttcaccatgttggccaggctgccctcgaacttctgacctcaagtgatccacctgcctcagcctcccaaagtgctgggattacaggcatgagctactgtgcctggcccaaagcagcatttgaactgagttttgaagaaagaattgaggttaaccattcaaagaaggggaaatggacttttctgacagagggaccagcaaaagcaaatacatggtactatgaacctgtactctcaatcacaggtgttttagggaactacatattattcagtgtcaacagagtaaaatttgaatgtggaaagggatggtaaagaggagactgtagacataagtgggagctggttatgaaaggccatgaatgtgacactaaggactttgtgctttattctatgggggagttcagtgtggaggataagagcactggatctggaatcacattgcctgtgtttgcttcctggcagtaccacttactggttgtgtgtccttgagcaagttacttaacctttctgtgcatctgtgacctttttccaaaggggatattaacattgcttatatcatatggtgattgaattaatacatgtcaagcacttagaactgtgcttgcc

SEQ ID NO: 7026 - DNA, 1623 bp, Homo sapiens
gcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagatgatatgatcttttatttggaaaaacctaatggctccaccaaaaaactattagaactgataaacaaattcagtaaagttgcaagatacaaaatcaacatacagaaaatcagtagcatttctgtatgtcagcagcagacaatgtgaagaagaaatcaagaaagtaatcccatttacgatagtttaaaataaaatacctaggaattaaccaaagaagtgaaagatctctacaatgaaaactataaaacatcgatgagagaaattgaagtggactccaaaaattggaatgatattccatgttcatggattggaagaatcagtattgttaaaatgcccacactgcctaaagcagtctacagattcagtacaattcctatcaaaataccaatgacattcttcatagaaatagagaaaacaatcctaaaatttatatggaaccacaaaagacccagaatagccaaagctattctgagcaaaacaaacaaaactggaggaatcacattacctgacttcagattatactacaaagctatagtaaccaaaaacagcatggtactggcataaaaacagacacatagaccaatggaacagaatagagaacccagaagccatatatctacaatgaactcatttttgacagatgccaagaacatacattggggaaagaacagtctcttcaataaatggttctgggaagactggatattcatatgcagaagaatgaaactagactcctatctcacaaaaatcaaatcaaaatggattaaagacttaaatctggccaggcgcagtggctcacacctgtaatcccaacactttgggaggccaaggcaggtggatcacgaggtcaggagttcaagaccagcctggccaagatggtgaaaccccatctttactaaaaaactacaaaaaaactagccgggtgcagtggcaggtgcctgtaatctcagctactcgggaggctgaggcaggagaatcgcttgaacccgggcagcagaggttgcagtgagccaagatcgcgccactgcactccagcctggccgacagagtaagactctgtct

SEQ ID NO: 7027 - DNA, 10217 bp, Homo sapiens
ctgcggctgcgtttcccccaccgggtacaaagcaaggagccaacgcccaaggtgaaacgaaaagggctagggggtgctggtgggggcagctctccctccaagtcaccccccgtgctggggccacagcaggccctgtctgaccggccctgccttgtggtcctgcataagccactggacaaactgctcatcaggtatgagaagctgcccttggactaccgggcacccttcttgctgacattggagccaccaggtccactgcccttggtgtcaggccgctcagcctcttctagcctggcgtcactgtcccgctacctctaccatcagcgctggctttggagtgtcccgtcaggactggcccctgcgctgcctctcagtgccattgcccagctcctctccatcctcactgaagtccgactttctgaaggattccacttcgcctgcagtggggaaggaatcatcaacatggttctggagcttccaattcagaatgaaccaccagggcaggctgcagctgaagagaagcacacctgtgttgtccagtacatcctcttccccccacactctacctccaccaaagacagcttctcgacagatgatgacaatgatgtggaagtggaggccctggagggagactcagagctcaatctggtcactgaggtgtgggtggagccacagtatgggcgagtgggacctggccctggaatctggaagcacctccaggacctgacgtattctgagatcccgcaagctctccacccacgggatgctgcctgcataggctccatgctgagctttgaatacctgatacagctgtgtcagagcaaggaatggggtcctctgcccccagagccgagggtctctgatggattggatcagggaggagacacctgcgtccatgagatccctttccattttgacctaatgggattgctgccacagtgccagcagctccagatgttcttcctcttgcttgccagaggtgccgaggggccactgctgggggttcatgggatcccgaaggagcaagcagtcggcagcacccaggccacaggagactccgcttttacttccctgagtgtaggtcttcctgaaactctcaagcctctcatctctgcccagccccctcagtggcgctgctatgcaaggcttgtgaacccccagcatgtgtttctgacttttctcccagctaccttctcagatgtccagcgtctggctgcctgtggcctggagggaccccctcaagaggagacaaagcctaagtttggggattggagtggggctcccagtctgaaagatctaggaggaactgggatcaaagctacaaagtcccacgtccctgtcctcagtgtgaccctggctagtgacaatgcccagaatcaaggagagctaagtccaccattccgtcgagacttacaggcttacgctgggcgtcaggcttcccagacagagagtgcggatgggccccggacccggtgtcctgtctacatctacagctgttcactggaagcgctgagggaacaaatggttggcatgcagccccctcaggcgccccgagacctcatcttccggactcagttcctcgaccacccctccccatcctcagcctggatggaaccccggtacaaggaggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctgggccaggtgctttccagtctggagggccccccagttggaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagaatgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgtggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcctgccagggcctgaaggacagatgtggggattgaaagggtgggagggcaaaggaaggtcctctcaccaacaatgggcaggaactcccggatgtttcctgtcaggttcccatccatgatctgccagtggaatatgtcctagggaagaggatactacattccgagaccccgcaggccccgccctccttccgatctgcgaagtacccccttccacttaccatttgtaattggaggttgggtcttcctaccttctgtaagatggctgccgctgtaagagaagccagggaggggaccgtgagcctcaagagcacaggaatcaaaagggacagaaggagagacagggctggggtcgtaccctgctggggcgtgtccaggaagtactgggggtcagtgatgcgggtgttgatgggctccagcagtcccacgaggtcctcctagcagcatgtcgggtgctgtgaatagagctccttcccaagtttgtcccccatcagtcagtcactggtcaaggccctcacctgttcctctgacctaggctggcagcctcacgtgctgtccccactgtgcacccccttctccgcacacccacagagacatgtaagtacgtgtgtgtttccacctttctcacctgagccaaaaccccagctgcatgcctcaggttctccagaaaaacggcctccatctcagccttgactgctattcgatcagctccctggggtactcggccagccatcaggtggatcctgtggggaagatggactggaggccttgcctcccttggctctctctgcacctcttccaggattccctgactgtgccagccctcgtccgtctccccaggtctccagtccatggcacctgggtcacgatgcccaggtatcccagcactttcagagacacttcagtgatggctgaggggcaagccctttcccagacatctcagtgtccacccaccgcctcctgcctccagtactttccaaaacctttccttccctcggtccttctccgcaacctgtaacctgctaaattctcacctttaaaaattgtcctgaccttt

SEQ ID NO: 7028 - DNA, 1191 bp, Homo sapiens
ggttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagagacagggtttcaccatgttggccaggctgccctcgaacttctgacctcaagtgatccacctgcctcagcctcccaaagtgctgggattacaggcatgagctactgtgcctggcccaaagcagcatttgaactgagttttgaagaaagaattgaggttaaccattcaaagaaggggaaatggacttttctgacagagggaccagcaaaagcaaatacatggtactatgaacctgtactctcaatcacaggtgttttagggaactacatattattcagtgtcaacagagtaaaatttgaatgtggaaagggatggtaaagaggagactgtagacataagtgggagctggttatgaaaggccatgaatgtgacactaaggactttgtgctttattctatgggggagttcagtgtggaggataagagcactggatctggaatcacattgcctgtgtttgcttcctggcagtaccacttactggttgtgtgtccttgagcaagttacttaacctttctgtgcatctgtgacctttttccaaaggggatattaacattgcttatatcatatggtgattgaattaatacatgtcaagcacttagaactgtgcttgcca

SEQ ID NO: 7029 - DNA, 12281 bp, Homo sapiens
atggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggtgctggtacagggctgcctcttggacccttcccagcgggaggtgttcctgcagcagatatatgagcagctctgcctctttgaggataaggtggccaccatgctgcagcagcagtacgatccccagagccaggcagaagaccagtccccagactcaggggacctactgggccggaaggtaggcgtctccatggtgacagctgatcttgggctggtcagtatgattcgtcagggcatcttggcactgcagttactaccctcgaactctagtgcagggattatcgtgatcacggatggggtgaccagtgtacctgatgttgctgtctgtgagacactgctgaaccagcttcgcagtggcactgtggcttgttcctttgtccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggctctcagcaccgcctatttaatgagcacctggtctctgcaagcagcaaccctgccctggccttgcgccggaagaagcacactgagaaggaggtgccagccgacttggtcagcactgtgtccgtacggcttcgagagggctacagtgtccgagaggtcacactggccaaaggagggtcccaattggaggtaaagctggtgctgctgtggaaacacaacatgcgcattgagtatgtggctatggcaccctggcccctggagcctgagggccctcgagtaacacgggtggaagtgacgatggaaggcggctacgacattttgcatgatgtgtcctgtgcactaaggcagcccattcgttcattgtatcgtacccatgttatccggcgtttctggaacacgctgcagagcatcaaccagacagaccagatgcttgcccaccttcagtccttctcctcagtgcctgagcatttcacgcttcctgacagcaccaagagcggagtgccactcttctacatccctccaggctccaccaccccggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacaccaatccccaagcacttgcacaccccgggcagcaatgggcgctacagcactatccagtgcaggatctcccactcctccctgacctctctgctgcgggactggagcagcttcgtactagtcgagggctattcttatgttaagctgctctccagtgccccagaccagccccccaattccttctacatggtccgtatcatttccaaggccccatgcatggttcttcgcctgggttttcccattggcacaccagcaccggcccggcacaagattgtgtcaggcttgagggaagagatcctgcggctgcgtttcccccaccgggtacaaagcaaggagccaacgcccaaggtgaaacgaaaagggctagggggtgctggtgggggcagctctccctccaagtcaccccccgtgctggggccacagcaggccctgtctgaccggccctgccttgtggtcctgcataagccactggacaaactgctcatcaggtatgagaagctgcccttggactaccgggcacccttcttgctgacattggagccaccaggtccactgcccttggtgtcaggccgctcagcctcttctagcctggcgtcactgtcccgctacctctaccatcagcgctggctttggagtgtcccgtcaggactggcccctgcgctgcctctcagtgccattgcccagctcctctccatcctcactgaagtccgactttctgaaggattccacttcgcctgcagtggggaaggaatcatcaacatggttctggagcttccaattcagaatgaaccaccagggcaggctgcagctgaagagaagcacacctgtgttgtccagtacatcctcttccccccacactctacctccaccaaagacagcttctcgacagatgatgacaatgatgtggaagtggaggccctggagggagactcagagctcaatctggtcactgaggtgtgggtggagccacagtatgggcgagtgggacctggccctggaatctggaagcacctccaggacctgacgtattctgagatcccgcaagctctccacccacgggatgctgcctgcataggctccatgctgagctttgaatacctgatacagctgtgtcagagcaaggaatggggtcctctgcccccagagccgagggtctctgatggattggatcagggaggagacacctgcgtccatgagatccctttccattttgacctaatgggattgctgccacagtgccagcagctccagatgttcttcctcttgcttgccagaggtgccgaggggccactgctgggggttcatgggatcccgaaggagcaagcagtcggcagcacccaggccacaggagactccgcttttacttccctgagtgtaggtcttcctgaaactctcaagcctctcatctctgcccagccccctcagtggcgctgctatgcaaggcttgtgaacccccagcatgtgtttctgacttttctcccagctaccttctcagatgtccagcgtctggctgcctgtggcctggagggaccccctcaagaggagacaaagcctaagtttggggattggagtggggctcccagtctgaaagatctaggaggaactgggatcaaagctacaaagtcccacgtccctgtcctcagtgtgaccctggctagtgacaatgcccagaatcaaggagagctaagtccaccattccgtcgagacttacaggcttacgctgggcgtcaggcttcccagacagagagtgcggatgggccccggacccggtgtcctgtctacatctacagctgttcactggaagcgctgagggaacaaatggttggcatgcagccccctcaggcgccccgagacctcatcttccggactcagttcctcgaccacccctccccatcctcagcctggatggaaccccggtacaaggaggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctgggccaggtgctttccagtctggagggccccccagttggaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagaatgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgtggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcctgccagggcctgaaggacagatgtggggattgaaagggtgggagggcaaaggaaggtcctctcaccaacaatgggcaggaactcccggatgtttcctgtcaggttcccatccatgatctgccagtggaatatgtcctagggaagaggatactacattccgagaccccgcaggccccgccctccttccgatctgcgaagtacccccttccacttaccatttgtaattggaggttgggtcttcctaccttctgtaagatggctgccgctgtaagagaagccagggaggggaccgtgagcctcaagagcacaggaatcaaaagggacagaaggagagacagggctggggtcgtaccctgctggggcgtgtccaggaagtactgggggtcagtgatgcgggtgttgatgggctccagcagtcccacgaggtcctcctagcagcatgtcgggtgctgtgaatagagctccttcccaagtttgtcccccatcagtcagtcactggtcaaggccctcacctgttcctctgacctaggctggcagcctcacgtgctgtccccactgtgcacccccttctccgcacacccacagagacatgtaagtacgtgtgtgtttccacctttctcacctgagccaaaaccccagctgcatgcctcaggttctccagaaaaacggcctccatctcagccttgactgctattcgatcagctccctggggtactcggccagccatcaggtggatcctgtggggaagatggactggaggccttgcctcccttggctctctctgcacctcttccaggattccctgactgtgccagccctcgtccgtctccccaggtctccagtccatggcacctgggtcacgatgcccaggtatcccagcactttcagagacacttcagtgatggctgaggggcaagccctttcccagacatctcagtgtccacccaccgcctcctgcctccagtactttccaaaacctttccttccctcggtccttctccgcaacctgtaacctgctaaattctcacctttaaaaattgtcctgaccttt

SEQ ID NO: 7030 - DNA, 1620 bp, Homo sapiens
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagcctttttaactgtccctgtgaatgaacaattttgagtgacctac

SEQ ID NO: 7031 - DNA, 1633 bp, Homo sapiens
aagtcgcagatgtgacgatgcaaaaacgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataa

SEQ ID NO: 7032 - DNA, 817 bp, Homo sapiens
cgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagc

SEQ ID NO: 7033 - DNA, 694 bp, Homo sapiens
agacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 7034 - DNA, 1054 bp, Homo sapiens
ggaagaaaccgaggcccagggattacacagccagtagagagaggacagagcatggagctcctggagaggcagtggataattcttcccgacagaggagctgactgttgaaccccttctttgaaggagagtccgtgctgccaaatcgaagaagagaaacgccctggctggaaagcagagagaacagcagtcgcaggttcggctcagaaactccagtgtccctcagcgtctcgccggcaccctctgccggcgtgaggtggcgctgcctggccgcatcctgggggagcgtccacatcctcggtcgacaaaaggagcgtcgacactctcggacctgggaaagtgacggcccaaacgccagggaggagccaggacctcgccctgagctagcgggagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactgag

SEQ ID NO: 7035 - DNA, 2315 bp, Homo sapiens
gcgcggggcggggcttccgggcggggcaggctggcttccggcgggagcggggccgcggatggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 7036 - DNA, 3469 bp, Homo sapiens
gggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaatttttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctg

SEQ ID NO: 7037 - DNA, 1704 bp, Homo sapiens
cgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgtggcctctgaagctatagccttcggtacattctactgaaaaagagcctggagcagcaatttccgaatcacctactctttgaggaggacagagctgcccaggctacaggggagtttgaggtgtttgtgaacgggagactggtccattccaagaagaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagcacccctgtgtccagtctgactgtgtctgctgtcgccacactcacctctgaggtctgtggaagtcacctgatattctggccccaggggtgggagggaggggagcttggaaggctagtcctgtagctccagtcctctgtctggcctccactcctcttgctcctgagggcagtttgtttcttttgtggattcgtcatttcccatgccctggttccagatacattttgaaaaccttccatcttattggcattttctggggttgtgagggaaacggggatggcagtcagactcaaacccgtgacactccaaactcgattatgctccagggcccactttctaaacctgtaagatctatgttccagcctgcgcaacatagtgagaccccaactctacaaaaaataaaaaattagccaggtgtggtggtgt

SEQ ID NO: 7038 - DNA, 1704 bp, Homo sapiens
cgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgcttcattcattcctatagccttcggtacattctactgaaaaagagcctggagcagcaatttccgaatcacctactctttgaggaggacagagctgcccaggctacaggggagtttgaggtgtttgtgaacgggagactggtccattccaagaagaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagcacccctgtgtccagtctgactgtgtctgctgtcgccacactcacctctgaggtctgtggaagtcacctgatattctggccccaggggtgggagggaggggagcttggaaggctagtcctgtagctccagtcctctgtctggcctccactcctcttgctcctgagggcagtttgtttcttttgtggattcgtcatttcccatgccctggttccagatacattttgaaaaccttccatcttattggcattttctggggttgtgagggaaacggggatggcagtcagactcaaacccgtgacactccaaactcgattatgctccagggcccactttctaaacctgtaagatctatgttccagcctgcgcaacatagtgagaccccaactctacaaaaaataaaaaattagccaggtgtggtggtgt

SEQ ID NO: 7039 - DNA, 2919 bp, Homo sapiens
tctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcca

SEQ ID NO: 7040 - DNA, 1090 bp, Homo sapiens
acaaaacagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcaca

SEQ ID NO: 7041 - DNA, 574 bp, Homo sapiens
gaatctggactgggaaagttgacattaatcaactcattattcctcacagatttgtattctccagagtatccaggtccttctcagagaattaaaaaacctgtacagatggaacaatccaaagttttaatcaaagaaggtggtgttcagttgctgcttacaatagttgataccccaggatttggagatgcagtggataatagtaattgctggcagcctgctatcaattatattgatagtaaatttgaggactacctaaatgcagaatcgcgagtgaacagatgtcagatgcctggtaacagggtgcagtgttgtttatacttcattgctccttcaggacatgggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtactgcaaacaccatttcatgataccttaattcaaataaacctttgtttaatcaa

SEQ ID NO: 7042 - DNA, 423 bp, Homo sapiens
atggaacaatccaaagttttaatcaaagaaggtggtgttcagttgctgcttacaatagttgataccccaggatttggagatgcagtggataatagtaattgctggcagcctgctatcaattatattgatagtaaatttgaggactacctaaatgcagaatcgcgagtgaacagatgtcagatgcctggtaacagggtgcagtgttgtttatacttcattgctccttcaggacatgggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtactgcaaa

SEQ ID NO: 7043 - DNA, 3996 bp, Homo sapiens
actgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 7044 - DNA, 3937 bp, Homo sapiens
gtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 7045 - DNA, 3026 bp, Homo sapiens
aggagctggatcagatctgaatccagaggctctcggaggaagagctcaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 7046 - DNA, 4453 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 7047 - DNA, 1997 bp, Homo sapiens
cgagcgccgccggaaagcgtcgagcggcttcggtaggtggggcggggccggggcggggccggggccggggaggggccaggcccggcacccggatcccgaggtccgcgccccgcgcccggcgccgggcgcccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacca

SEQ ID NO: 7048 - DNA, 440 bp, Homo sapiens
atgaaggggatctgctcagacgccatccttgttctagctacctccatgtggatggcctttgcaattgacttcccccttcctatggcctctgaaagaggtcagctagacaaaacaatagttgaatgcctcaagaatgtaaataagtgctggtttttatcctacatcaagcccagtgaacctatttgtggcagtgaccaggttacctacagtagtgactgccatctgtgctccaaaattctatttgaagggcttaacataactaaactgtatgatggacaatgtgaaaactcttgaacgtacgacaaagaattataaaacctactgaatctccagattgccaagtgaaacacaatggttgcctcttcaaatatatcccctttaattactaatggttggatcaaactcgttgatttatgtcttcaataaatgattcttagcag

SEQ ID NO: 7049 - DNA, 3611 bp, Homo sapiens
agcatttcagcaagcggcggcagcacccgcggggaggcagagggtgcggggccgtgggggccgcggagctgccctgcccaactcagcccagactaggcggcagcccggaccggcgggacccgagggcctggccccagcgcccggtagatcgcggcggtcagcggtgagggccagcggcccaggccagcggctccagggccagccacgatgtcctccaccgtgaacaacggggcggccagcatgcagtccacacccgacgccgcgaacggcttcccgcagcccagctcctcctcggggacctggccgcgggcggaagaggagctgcgcgccgcggagccgggcctggtgaagcgcgcgcaccgcgagatcctggaccacgagcgcaagcggcgggtggagctcaagtgcatggagctgcaggagatgatggaggagcaggggtattcggaggaggagattcggcagaaagtggggacattccggcagatgctgatggagaaggagggagtgctcaccagggaggaccggcctgggggccacattgtggcggagaccccgcggctgaccgagggcgctgagccgggcctggagtacgcgccctttgacgatgacgacggcccagtggactgtgactgcccggcctcctgctaccgcggccaccgcgggtacaggaccaagcattggtctagcagctcggcatcgccccctcccaagaaaaagaagaaaaagaaaggcggccaccggagaagccgcaaaaagaggagactggagtccgaatgcagctgtgggagctcctcacccctccgcaagaagaagaagagtgtgaagaagcatcgccgagacaggtctgattctgggtcccggaggaagagacggcacagatctcgaagctccaagtgcaaaagaaaagagaagaacaaagagaagaagaggcctcacacagagtccccaggccggaggtctcatcgccatagcagtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgataagcccagctcgccctcgcccagggtccgtgacaaggcggcggccgccgcacccacgccgcccgcgcgggggaaggagagcccgagcccgcgctcggcgccgtcgtcccaaggtcgcggaggccgcgcggcgggcggggcgggcaggcggcggcggcggcggcgtaggcggcggcgctcgcggtcctcggcgtccgcgccccgccgcaggggtcgccggcgcccccggcccgcgcccccccggggctcgtcgcgctcgctcagcagggcccgctccagcagcgactccggcagcggccgcggcgcccccggccccgggcccgagcccggctctgagcgaggccacggcggacacgggaaacgggccaaggagcggcccccgcgcgcgcggcccgccagcacctctccgtccccgggcgcgcacggccggcgcggcggcccagaagggaagagctcgtcgcgcagccccggcccgcacccccgctcctggagctccagccgctcgccctccaaatctcgctcgcgctctgcggagaagcggccccacagccccagccgctcgccgtcgcccaagaagcccctcagccgggacaaggacggcgagggccgcgcaaggcactctgaggccgaggccacccgcgcccggcgccgctcccgcagctactcgcccatccgcaagcggcgccgggactcgccaagcttcatggagccgcggcgcatcaccagcgccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccgg

SEQ ID NO: 7050 - DNA, 3614 bp, Homo sapiens
ccagcatttcagcaagcggcggcagcacccgcggggaggcagagggtgcggggccgtgggggccgcggagctgccctgcccaactcagcccagactaggcggcagcccggaccggcgggacccgagggcctggccccagcgcccggtagatcgcggcggtcagcggtgagggccagcggcccaggccagcggctccagggccagccacgatgtcctccaccgtgaacaacggggcggccagcatgcagtccacacccgacgccgcgaacggcttcccgcagcccagctcctcctcggggacctggccgcgggcggaagaggagctgcgcgccgcggagccgggcctggtgaagcgcgcgcaccgcgagatcctggaccacgagcgcaagcggcgggtggagctcaagtgcatggagctgcaggagatgatggaggagcaggggtattcggaggaggagattcggcagaaagtggggacattccggcagatgctgatggagaaggagggagtgctcaccagggaggaccggcctgggggccacattgtggcggagaccccgcggctgaccgagggcgctgagccgggcctggagtacgcgccctttgacgatgacgacggcccagtggactgtgactgcccggcctcctgctaccgcggccaccgcgggtacaggaccaagcattggtctagcagctcggcatcgccccctcccaagaaaaagaagaaaaagaaaggcggccaccggagaagccgcaaaaagaggagactggagtccgaatgcagctgtgggagctcctcacccctccgcaagaagaagaagagtgtgaagaagcatcgccgagacaggtctgattctgggtcccggaggaagagacggcacagatctcgaagctccaagtgcaaaagaaaagagaagaacaaagagaagaagaggcctcacacagagtccccaggccggaggtctcatcgccatagcagtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgataagcccagctcgccctcgcccagggtccgtgacaaggcggcggccgccgcacccacgccgcccgcgcgggggaaggagagcccgagcccgcgctcggcgccgtcgtcccaaggtcgcggaggccgcgcggcgggcggggcgggcaggcggcggcggcggcggcgtaggcggcggcgctcgcggtcctcggcgtccgcgccccgccgcaggggtcgccggcgcccccggcccgcgcccccccggggctcgtcgcgctcgctcagcagggcccgctccagcagcgactccggcagcggccgcggcgcccccggccccgggcccgagcccggctctgagcgaggccacggcggacacgggaaacgggccaaggagcggcccccgcgcgcgcggcccgccagcacctctccgtccccgggcgcgcacggccggcgcggcggcccagaagggaagagctcgtcgcgcagccccggcccgcacccccgctcctggagctccagccgctcgccctccaaatctcgctcgcgctctgcggagaagcggccccacagccccagccgctcgccgtcgcccaagaagcccctcagccgggacaaggacggcgagggccgcgcaaggcactctgaggccgaggccacccgcgcccggcgccgctcccgcagctactcgcccatccgcaagcggcgccgggactcgccaagcttcatggagccgcggcgcatcaccaggcgccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccgg

SEQ ID NO: 7051 - DNA, 3611 bp, Homo sapiens; identical to SEQ ID NO: 7049

SEQ ID NO: 7052 - DNA, 3614 bp, Homo sapiens; identical to SEQ ID NO: 7050

SEQ ID NO: 7053 - DNA, 2397 bp, Homo sapiens
acaagcccttttgcgcccaccatgtcttcacctaagagatcttcaaagcccagtatgtctctggcacccagtggatcctccatgcccactgcggatcccaagcctcctgcctccttgaagtccaccaaatcagcaacacccaacagatccttagtgcccaccaaaccagcgacatcccgtaactcagtcatgagcccaagcagttccaagtccaccaaatcgaccagtacaaaaagagccccttctaaccggcccagcagcaggtcccgagtccgcagcaaagcaagaacacccagcagggtgagcaccgacaccaggaccagcaaagccagcaaggccagcgacgtgagatgccaccagcggaggggcacacacagccggggtaggacacctggcagaaggggaagccgcagctccaagaggtcacccagcagggccagcactcctggcaggataagaactcatggtgccagaccaggcatggccagcagggtgagaactcccacttcacagcaaaaagggagccggggaaagagttacggccggcctagaaccagcaacagggaaaggagtgacagccagcctagaaatctgagcaagaagagttaccgcccaccaggaggctcaggtatagggaggagttccgagctggctgtaactcccagtacagccaagtgtcaaaccccgactggaattccctccaaggagaagagtgacaacccatctccatcctcatcaaggaaggtgaagagctacggtcagatgatcatccccagtagggaaaagagttacagccccactgaaatgtccagcagggtcaagagttataaccaggccagcacccgcagcaggccgcaaagtcacagccaatctagaagccccagaaggtcaagaagtggcagtcagaagaggacgcacagcagagtgagaagtcacagttggaagagaaaccatagcagggcaagaagtcgcacccggaagggaattctgagccagatgggaagacacagccagtctagaagccacagcaaggggaaaagtcaaaaccaatctagaacccccagaagaggaagaagtcacaactggtctagaaaccccagcaaggaaagaagtcatagccattccagaagctccagcaaagagagagatcacaggggatctagcagccccaggaaggagagtggtcgcagtcaatcaggaagccccaacaagcagagagatcacagccgatctagaagtcccaacaaggcgagagatcgcagccgatctagaagtccctacaaggcgagagatcgcagccgatctagaagtcccaacaaggcgagagattgcagccgatctagaagtccctacaaggcgagagatcgcagccgatctagaagtcccaacaaggcaagagatcatagccgatctagaagtcccaacaaggcgagagatcgcagccgatctagaagccccagcaaggaaagagatcacagccaacttggaagccccagcaaagagagagatcacagacgatctagaagccccagcaaggagagacagtgcagacaatctagaagctccagcaaagagagagatcacagacgatctagaagccccagcaaggagagacagcgcagacaatctagaagccccaacaaggagagagatcgcagccaatctagaagccccagcgaggagagagagcacagacaatccagaagccccagcaaagagagagatcgcagacgatggagaagccccagcaaggagagagagcgcagacaatctagaagctccagcgaggagagagatcacagccgatctagaagccccaataagcagagtggttacagtcgacctagagcctccagcaaggagaaagctcatagccgatctagaacccccagcaaagaaggaaatcatagccaatctagaacctctagcaaggagagcgaccccagtcaatctacagtccccagaagtcccgactggaagagatcccctactaggacaagcagtctcagtcagaatagaacccctagcaagacaagcagccactccccatcaacatttcccagtgggggccaaaccctaagccaggatgacagtcaagccgacgccaccacctctaaggccaccttacctggggaaaggtcttcatcatcttcttccaagctggcgtagcccccagtctcagctggctcacgggtctctgtcatgaccgggggaggggacaggagacaggagcagagcagcagctgagcagcgtccctccccggccagctctccacagccacacctccggccacaagttctctaatacaggatgttggcaggtagagagggatgctggatagggggaaaggaaagacctgtgatgattcaataaatttttacatagcacccatcccc

SEQ ID NO: 7054 - DNA, 2698 bp, Homo sapiens
aacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctttggcctgtgacaggcaatcaggtcatcgtccacggctaccaggtgtttcatgtctactgtgacttccaggaccacaagcccttttgcgcccaccatgtcttcacctaagagatcttcaaagcccagtatgtctctggcacccagtggatcctccatgcccactgcggatcccaagcctcctgcctccttgaagtccaccaaatcagcaacacccaacagatccttagtgcccaccaaaccagcgacatcccgtaactcagtcatgagcccaagcagttccaagtccaccaaatcgaccagtacaaaaagagccccttctaaccggcccagcagcaggtcccgagtccgcagcaaagcaagaacacccagcagggtgagcaccgacaccaggaccagcaaagccagcaaggccagcgacgtgagatgccaccagcggaggggcacacacagccggggtaggacacctggcagaaggggaagccgcagctccaagaggtcacccagcagggccagcactcctggcaggataagaactcatggtgccagaccaggcatggccagcagggtgagaactcccacttcacagcaaaaagggagccggggaaagagttacggccggcctagaaccagcaacagggaaaggagtgacagccagcctagaaatctgagcaagaagagttaccgcccaccaggaggctcaggtatagggaggagttccgagctggctgtaactcccagtacagccaagtgtcaaaccccgactggaattccctccaaggagaagagtgacaacccatctccatcctcatcaaggaaggtgaagagctacggtcagatgatcatccccagtagggaaaagagttacagccccactgaaatgtccagcagggtcaagagttataaccaggccagcacccgcagcaggccgcaaagtcacagccaatctagaagccccagaaggtcaagaagtggcagtcagaagaggacgcacagcagagtgagaagtcacagttggaagagaaaccatagcagggcaagaagtcgcacccggaagggaattctgagccagatgggaagacacagccagtctagaagccacagcaaggggaaaagtcaaaaccaatctagaacccccagaagaggaagaagtcacaactggtctagaaaccccagcaaggaaagaagtcatagccattccagaagctccagcaaagagagagatcacaggggatctagcagccccaggaaggagagtggtcgcagtcaatcaggaagccccaacaagcagagagatcacagccgatctagaagtcccaacaaggcgagagatcgcagccgatctagaagtccctacaaggcgagagatcgcagccgatctagaagtcccaacaaggcgagagattgcagccgatctagaagtccctacaaggcgagagatcgcagccgatctagaagtcccaacaaggcaagagatcatagccgatctagaagtcccaacaaggcgagagatcgcagccgatctagaagccccagcaaggaaagagatcacagccaacttggaagccccagcaaagagagagatcacagacgatctagaagccccagcaaggagagacagtgcagacaatctagaagctccagcaaagagagagatcacagacgatctagaagccccagcaaggagagacagcgcagacaatctagaagccccaacaaggagagagatcgcagccaatctagaagccccagcgaggagagagagcacagacaatccagaagccccagcaaagagagagatcgcagacgatggagaagccccagcaaggagagagagcgcagacaatctagaagctccagcgaggagagagatcacagccgatctagaagccccaataagcagagtggttacagtcgacctagagcctccagcaaggagaaagctcatagccgatctagaacccccagcaaagaaggaaatcatagccaatctagaacctctagcaaggagagcgaccccagtcaatctacagtccccagaagtcccgactggaagagatcccctactaggacaagcagtctcagtcagaatagaacccctagcaagacaagcagccactccccatcaacatttcccagtgggggccaaaccctaagccaggatgacagtcaagccgacgccaccacctctaaggccaccttacctggggaaaggtcttcatcatcttcttccaagctggcgtagcccccagtctcagctggctcacgggtctctgtcatgaccgggggaggggacaggagacaggagcagagcagcagctgagcagcgtccctccccggccagctctccacagccacacctccggccacaagttctctaatacaggatgttggcaggtagagagggatgctggatagggggaaaggaaagacctgtgatgattcaataaatttttacatagcacccatcccc

SEQ ID NO: 7055 - DNA, 5393 bp, Homo sapiens
gtgcgctgggcggcgctcggaccccttggcagccgcaggtgcctccccagcccagcccagctcagtccagcgcagcccagcccagcccagcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactgggatgcagtttttcagaagaggctcattccaggtttcattcctaataaaggcaggctgaattgtgatcctacctttgaacttgaggaaatgattttggagtccaaacctctacataagaaaaaaaagcgtctggcaaagaaggagaaggatatgaggaaatgcgattcttctcagacatgtcttcttcaagagcaccttgactctgtccagaaggagttcataattttcaacagagaaaaagtaaacagggactttaacaaaagacaaccaaatctagccttggaacaaaccaaagacccacaaggtgaggatggtcagaataacaacttgtaaaggcctcatgtcttcttcttgggacaatctcatgccagaaacttctaattacatatgtcaagaaaagctgacagtagttcttgccactccacacaccatgacttagaaaatgtgaatgaatatatttcaaaaaaggcagcacaacacagtgaagggtcctgggcctgagctcctgggatgtcatttcacatcaatcaactgtgtgatctagagcaagtcacttagccactttctgtgctttactttatttatctaaaatgagagggttatactagacgagccataccctgcctttttagtgctatagttgttattctaaaccgcctttatttttattttaaaattaatatatgaatatagatttatttttccactccttctaattatgcagtgacaaatggacaaatggacacaggactcagtgagacttttcagacctcgaaagtttcataaagtggtcagaatgccccaggctacttggataaagataaggaattctatcagggaggcatgaatggaatcagattaaaagtaacagagatggatgagggccttccagtgatatgcgtgaatcagcattagatccgcttatctcagctggcaggagcctgctgtgcacaccacttcccagctccctcttcaacaatgtgaaagtggtaacttgaaattggtaataatgggagcatttacaccacggaaactggtaaatgctcgttttttccctcctaacaagtgaattgctaaatattagcccaccactccttccaagaagcatgttccttgagggctaattgtcctctgaagattagcagagacctgtatctggagaggatcagaaaagaatgtcatcacactgaaagtatgtccaccttgcagttcagaaaagttgcatcttatatggggtttattgtctaagttagaaatgaatttagaagatagtaaaatttaccgttgaaaaaccccttaaattacccataaagtatatgggaagtatcttttctcagtaaagcccaatacagtgtcacctttcactaatgaaacaagccattgcttttgttttgttttgacttagttatttttatttttggtctcattttggctaataccagatgagctaaaatgttgaacaaattatacttgtttttatagactagaattactcttttttttcttttcaggcagagtctcactctgtcacccaggctggagtgcagtggcatgatctctgctcactacatctgcctcccgggttcaagtgattcttgtgtctcagcctcctaagtagctgggatcgcatgtgtgtgccaccatgtgtagctaattttttgtatttttagtagagataggattttgctaagctggccaggttggtttcaaactcctggtctcaagtgatccgcccaccttggcctcccaaagtgctgggattacaggcgtgagccaccaaacctggccttagaattactcttagaacagtggaatgcccacacatccaagacaggcaagttcatggagactaagggaacagtggtatcatgtctcccttctcccttgtgcttactacaagaatggcaggcagaattccctacttatttaaaatatcactgatgtctcactctttttctttatattttatttattgatttgccacaaagtttaattcacctaagtgagacgtgcatatgatgtaactccactgtacagatacacagatctttacagaagaactatttttggcaacccctatgcccctgggtagggtccagaagtgaacaggcttggtgggggattgttttcacctcttggctactcagagtacctaaacctgtccttacttatggagagcatgtgtcacaccaagatggcagtaagctggcaactgcgaagacctgactgatgcccatttgggaagccaggcaagtgaaaatggaccgaagaaacagagatggctgtcttttatgcagggcttttccataaagaggttacactggggcaaccaagtatgtgtagaaagccagagctaaacttcagcttggcattcacagttttctcttcactgagctaataggcccagagtttcgggcagagctgtgaaatagtgcttctctaatagcaaccatattattgttacataattaaaagccagctcttttgttgtttgtttgattccttttccctacagttcccacatcatttgtctgtgctattctgtttttctccaaacactataaacttgaagcaattgccctgactcgatttcagagaaggggatgtgttggaaagagcaagaataagaaagtgaccagattctgctgcagtctggtaaccccacgagtgtcagggactacttgcatgtttacttctatccttcatttgttttgattcaagcctttatgtgctgtggactcacctccctaagtaaccaggttcctcctctcgctgcaaccttgtttgcatccttcccaagaagaggctttgggaaatttttctgtaattacacttaccaaagagccatggaaccattaggatctccactgtgatgagagttaagccatagtgccatttcacacgtatacatttatgatgggatgggaacccgatacaatctctgtaggctgaatccctagttttatttccagtgagctgcttctgtgactgaagcacctctgtgggcttttgggaaccatggatgcacagatgagagagcacaggctcagagagtaagatggatttctagtgctagccaggtgaatgacacacagtgtatttcaagtttgaaaagcaaaaccatggtatctgacagtgctgattgtaatcacctcccaccactgtgcattttaaacatgagaacaaaaaacttttccaaaatttaaacttttcctaaatctttgtggtcattgctagttgttgacatcagatcctttggttttattctataacttgggctaaacgttaatatcccactaggtggaacatgtctcttccggagttgtgacaaccgaggctcagagctgtgatttttagaaaacaagatgactattaaatcctttggcctggtattcttgaatgtttttctcccagtgcttcccttgcctgtatggagcatctgcaaagtctgagcaggttttgaagtccaagagcatcccagctataaggctcttgcactgtgacagagctgcccacctccagtacaccctcagtgacctcgagtagatgcgtagggcagtcaaacccggcaacttatgccacaaccctaattccaggaagtcgtctgctaatggctaacccactgccatggtggcactggttttgcctgaggtcattgctagggcaggaatgaacagcaaccagcacagagcattgctaaattaattacagtaatctaattaattagtagctaggcttcttctgataggaaagtttcaaccagaaaccactagatgttctattatcatagcttttgtagattggatggaagaataagtaggaagaaagagtattaatgtagctagtagggaccagtgttgctgcttgtggctgaggcagtaatgctaaggctttagctcttcaaaagcagaatgaaaaggcacaaaaagcacttcaagcttgtttctgtacccagttgtccctgtattgtctacataaaatcctgtttcctgctatctgtctgtgattcctgtttattacaaattcagtgtgtctgactgatattaaacactgatattaaaatttcaaacttcacttatctgtgctgttgtgaacaggcagctgatctggcagccctcgaatgggaaacaagtgcttctgttgagctgtagcatatataatataaatgtgcctatgtgtattaaaatgtcttctgtaaacaa

SEQ ID NO: 7056 - DNA, 771 bp, Homo sapiens
agtccagcgcagcccagcccagcccagcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgtacaacaatacacccttaaatcacattga

SEQ ID NO: 7057 - DNA, 888 bp, Homo sapiens
agcccagctcagtccagcgcagcccagcccagcccagcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgatacctggctctcctacaagtcccactgaattggagtttcaggagaccgaagcccaggcacatgtattttgcaaaactacactgaagtttctgataatgacggatatcaacaattaaacgcttacttcttgccaaa

SEQ ID NO: 7058 - DNA, 3582 bp, Homo sapiens
ctgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 7059 - DNA, 3241 bp, Homo sapiens
gtagagagtgaagcagcaagactgcagagcctcatcaagaagtgtggagtgaagggaaggcttcagatggacaatttgtgtgctggggaaaaaatggaatgtgctgcaaattcccctgtggataagggtggacggctgctctgtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttgg

SEQ ID NO: 7060 - DNA, 2086 bp, Homo sapiens
acggcgggcgctgccggccccgagcgctcccgctaccactgccgctcccggccctgccggccggccatgccccgagttccggctgccgcgcgcacccagacccggcgatgaggagtggcgccgagcgcaggggcagcagcgccgcggcgtccccgggctcgccgccccccggccgcgcgcgccccgccggctccgacgcgccctcggccctgccgccgcccgctgctggccagccccgggcccgggactcgggcgatgtccgctcgcagccgcgccccctgtttcagtggagcaagtggaagaagaggatgggctcgtccatgtcggcggccaccgcgcggaggccggtgtttgacgacaaggaggacgtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgtctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcaggtcttggaggtcaagggcatgggttggggtagtgggtggggaggtgaatgttttctagagattcaaactgctccagcaatttctgtagttttcacctctgagaattacaatgtgagaaccgct

SEQ ID NO: 7061 - DNA, 733 bp, Homo sapiens
gcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagtcttctgagagcacaccccaggactgggattttgccaggaagatgtggaatggtgtggaaagacaagaagctgcagccttcaggctgccatgaaaaagctgggggtgtgttctgtggcccatcaagagggggtgtgtaatgaattgttaatgaatttctcagatgagccaaagtggtgaacttgtctcagtacccagggagactcagactcatccccagctcttggcctccattttcccagctgctgtgattggagtgggtccctggaattcatatgctggaaatttggtccaggtgtgggtgtgttgggaggtggggtttaaggtgtggttaggc

SEQ ID NO: 7062 - DNA, 830 bp, Homo sapiens
ccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcatgaacttcgaccacttccagatccttcgggccattgggaagggcagctttggcaaggtgtccccacgtgtccccaggcgtcctcaggcgtcctgccgaacagccctgtgccctccaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacc

SEQ ID NO: 7063 - DNA, 2010 bp, Homo sapiens
gtactttgcagttagagaggcgctcacctgtgccgcccgagtgcgagtgaggctcctgccccacaggtggcggggcccggccgctcagaggctcagtctccttggtgaccgcgcggtgtccatcctctgctcacccatgtgcgctggaggcagggccaggccgttgtgcaaagacctgccctgccaggaacgagtgcgctgctgagtcctgtagataaagccgccaaccccggggactggtgtctcctgagtgaccgtgcagccgtgggcgccatagaaagcagagaaggcagtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgtctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcaggtcttggaggtcaagggcatgggttggggtagtgggtggggaggtgaatgttttctagagattcaaactgctccagcaatttctgtagttttcacctctgagaattacaatgtgagaaccgct

SEQ ID NO: 7064 - DNA, 1980 bp, Homo sapiens
aaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcatgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgtctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctca

SEQ ID NO: 7065 - DNA, 607 bp, Homo sapiens
gcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagaagctgaaagcacaaccagtaccttctcaggagcgtggggaggccagccacccgggcagagcaaggagagaatgaggagtgacatgggtgttgccgtgagtggcgaaggggatggaagatttcagcacgatgctatttctaacaagtttcagcattccagtatctcttttcacaaataaaacatttactaaccatttgagcgta

SEQ ID NO: 7066 - DNA, 1415 bp, Homo sapiens
gccacttccgggagtcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctcatgtt

SEQ ID NO: 7067 - DNA, 953 bp, Homo sapiens
aggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 7068 - DNA, 1374 bp, Homo sapiens
ctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaagcaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 7069 - DNA, 1094 bp, Homo sapiens
aggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctc

SEQ ID NO: 7070 - DNA, 1127 bp, Homo sapiens
aggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctc

SEQ ID NO: 7071 - DNA, 1147 bp, Homo sapiens
cggtgtttggctgggttctagcgtagccgtctgtgtggccggtgggggacctgcggtcggagtgggagggccagtctgcacccaagaggtggaagaggacgggctttaggctggaagcgccttagaggagccatttttccagcaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggt

SEQ ID NO: 7072 - DNA, 1415 bp, Homo sapiens; identical to SEQ ID NO: 7066

SEQ ID NO: 7073 - DNA, 2313 bp, Homo sapiens
ggggtttgccctgggccgctgccggtcaggtcggccgcccctgacagctccgggagcctcaagcgcgacagcggcgccctcacctcgggacatccacacaccgaccgctcctgctccagaggcaacaacccagcgcgcctagcctggcgccgtgcagcgaagcccaagagctggcctcgccacgaaggttgaaccagccaaattttcgagacagctcacggcttagaggaaggttcatctaaataaaggccggctaaagtgacattgcagggattaaatccttctttggctgcctgtgtgaccagaaggcttatttgcaagtttcttctttcctggggtccagattattaggtctccagcgccctgcagcttgacagaaagagaagcatgaaatgaaggtcagagatgagatcccgcagcagggacgtgggggcctcccaggggcatttacgcaccagagtgcaagattctctggccatcaagggaaatagcaaacagaagcctttgtcctggggcacagccacctaccacaaagcatcagactccacgtctggccagaaagttcctggagtcccatcaggccagtgggtatgtaacatgtgcctaattgtacagctagagcctgcaagttcaacgtgagggaaggtgggaaatgtcttgagtgaggcgagcagctcctggctgggctgggcagactcagctaccacgttcactgccttcctctcactaaagccgagagggaggctgctcagctctcaggaaaactcttttgaaccctgggcacctgctgtcctcagttggcatctcccaccctctgagcctcttctgctcctgcacaacctgcctcttcgctgagatggagacgtgagcccccgtggacgatgactgcagtgtatatgaatggaggtggcctggtgaacccccactatgcccggtgggatcggcgcgacagtgtagaaagtggctgtcagaccgagagtagcaaggagggtgaggagggacagccccgccagctgacgcccttcgagaaactgacacaggacatgtcccaggatgagaaggtggtgagggagatcacgctggggaaacggataggcttctaccgaattcgaggggaaatcggaagtggaaacttctcccaagtgaagcttgggattcactccctaaccaaagaaaaggtggccattaagatcctggacaagaccaagttagaccagaaaacccagaggctactatcccgagaaatctccagcatggaaaagctgcaccatcccaacatcatccgcctttacgaagtggtggagaccctatccaagctgcacttggtgatggagtatgcagggggtggggagctcttcggaaaaattagcactgaggggaagctctctgaaccagaaagcaagctcatcttctcccagattgtgtctgccgtgaagcacatgcatgaaaaccaaattattcatagagatctgaaagcagaaaatgtattctataccagtaatacttgtgtgaaggtgggcgattttggattcagcacagtaagcaaaaaaggtgaaatgctgaacactttctgtgggtctcctccctacgctgcgcctgaactcttccgggacgagcactacatcggcatttacgtggatatctgggccttgggggtgcttttgtacttcatggtgactggcaccatgccatttcgggcagaaaccgtggccaaactaaaaaagagcatcctcgagggcacatacagtgtaccgccgcacgtgtcagagccctgccaccgactcatccgaggagtccttcagcagatccccacggagaggtacggaatcgactgcatcatgaatgatgaatggatgcaaggggtgccataccctacacctttggaacctttccaactggatcccaaacatttgtcggaaaccagcactctcaaggaagaagaaaatgaggtcaaaagcactttagaacatttgggcattacagaagagcatattcgaaataaccaagggagagatgctcgcagctcaatcacaggggtctatagaattattttacatagagtccaaaggaagaaggctttggaaagtgtcccagtcatgatgctaccagaccctaaagaaagagacctcaaaaaagggtcccgtgtctacagagggataagacacacatccaaattttgctcgattttataaattgcactagactgcttgtaactaaccaagatgattgttgctgcttctaaatttttttcaaggacaacttgagtggagacatttttgtaatttttaaataaacttaaatttgagatatgca

SEQ ID NO: 7074 - DNA, 2929 bp, Homo sapiens
agagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttcttttggaagaccgcacgaagtaaggaagagcctcttttcctcttcctggatatccctccaggaatattagaagctccaggactccttgatacgaccaggaaaagatcgcaaccgggtctttaaaatatcgattccagccagcttctgcgtgcttgacacatcttggcagatggagaagtcaaggcaatagataacatgggcagcaaagattctgctatagcacttctttcctttctgttttttccttccctccttccctccttttccctcttctccctccctcctttcctcctcctcctctccccttctcttctcctcctccctccctccctttctccctttctcctctcttttccccttccctcccctgttttcgtcctcctgagtacagtagacaagagggctctctgtctaccccccctcccccaccccattcctcatcccgtttcaaaataagagcgaatgaatcacattctaagctcttacccgtgcagttctgacaagtttggaaattacacaaatcgcgtttgcaattgaggccgcgggaatccaaaagggaaacaaacgaaaccagatgaaaaaaagtgattccaagtcaagatttcaaatggaaatctaaggttgaaccagccaaattttcgagacagctcacggcttagaggaaggttcatctaaataaaggccggctaaagtgacattgcagggattaaatccttctttggctgcctgtgtgaccagaaggcttatttgcaagtttcttctttcctggggtccagattattaggtctccagcgccctgcagcttgacagaaagagaagcatgaaatgaaggtcagagatgagatcccgcagcagggacgtgggggcctcccaggggcatttacgcaccagagtgcaagattctctggccatcaagggaaatagcaaacagaagcctttgtcctggggcacagccacctaccacaaagcatcagactccacgtctggccagaaagttcctggagtcccatcaggccagtgggtatgtaacatgtgcctaattgtacagctagagcctgcaagttcaacgtgagggaaggtgggaaatgtcttgagtgaggcgagcagctcctggctgggctgggcagactcagctaccacgttcactgccttcctctcactaaagccgagagggaggctgctcagctctcaggaaaactcttttgaaccctgggcacctgctgtcctcagttggcatctcccaccctctgagcctcttctgctcctgcacaacctgcctcttcgctgagatggagacgtgagcccccgtggacgatgactgcagtgtatatgaatggaggtggcctggtgaacccccactatgcccggtgggatcggcgcgacagtgtagaaagtggctgtcagaccgagagtagcaaggagggtgaggagggacagccccgccagctgacgcccttcgagaaactgacacaggacatgtcccaggatgagaaggtggtgagggagatcacgctggggaaacggataggcttctaccgaattcgaggggaaatcggaagtggaaacttctcccaagtgaagcttgggattcactccctaaccaaagaaaaggtggccattaagatcctggacaagaccaagttagaccagaaaacccagaggctactatcccgagaaatctccagcatggaaaagctgcaccatcccaacatcatccgcctttacgaagtggtggagaccctatccaagctgcacttggtgatggagtatgcagggggtggggagctcttcggaaaaattagcactgaggggaagctctctgaaccagaaagcaagctcatcttctcccagattgtgtctgccgtgaagcacatgcatgaaaaccaaattattcatagagatctgaaagcagaaaatgtattctataccagtaatacttgtgtgaaggtgggcgattttggattcagcacagtaagcaaaaaaggtgaaatgctgaacactttctgtgggtctcctccctacgctgcgcctgaactcttccgggacgagcactacatcggcatttacgtggatatctgggccttgggggtgcttttgtacttcatggtgactggcaccatgccatttcgggcagaaaccgtggccaaactaaaaaagagcatcctcgagggcacatacagtgtaccgccgcacgtgtcagagccctgccaccgactcatccgaggagtccttcagcagatccccacggagaggtacggaatcgactgcatcatgaatgatgaatggatgcaaggggtgccataccctacacctttggaacctttccaactggatcccaaacatttgtcggaaaccagcactctcaaggaagaagaaaatgaggtcaaaagcactttagaacatttgggcattacagaagagcatattcgaaataaccaagggagagatgctcgcagctcaatcacaggggtctatagaattattttacatagagtccaaaggaagaaggctttggaaagtgtcccagtcatgatgctaccagaccctaaagaaagagacctcaaaaaagggtcccgtgtctacagagggataagacacacatccaaattttgctcgattttataaattgcactagactgcttgtaactaaccaagatgattgttgctgcttctaaatttttttcaaggacaacttgagtggagacatttttgtaatttttaaataaacttaaatttgagatatg

SEQ ID NO: 7075 - DNA, 2619 bp, Homo sapiens
cgctcacttctgcttgcacttaggcgacctcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgttcagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctgcattcccttttttgttcttctttatgtataatatatagttcatgtggcgctgcatgaaatcaagaagtgggtgtcttaggataaaagataccaagagtctacaaaaataaccatgtagtaagataaactgctgaacaaaggttttactgttagccaccttctcatgtgttttcttttctctttttctttttctttctttctttcttttttttttttttgagacagagtcttgctctgttacccaggctggagtgcagtggcacgatctcagctcaccgcaacctctgcctcctgggttcaagtgattctcttgcttcagcctcctgagtagctgggattataggcatgcaccactaggcctggctaatttttgtatttttagtagagatggggtttttccatgttggccaggctggtcccgaactcctgacctcaggtgatccgcgcacctcagcctcccaaagtgctgggattacaggcatgagctaccatgcctggccttctcatgtgttttctgattaaggctcttgacttccaaggctgtgtggggagatggggtgggggctcttggactgatataaaactttgtcaaatgtagttctttgaatggagcttgaaacgccgcatattcttgctcccacaaggatagtgggcatcatgaattaataaaacgtcctaggattctgcaagcta

SEQ ID NO: 7076 - DNA, 1529 bp, Homo sapiens
gacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagggttatatcagttcctagcttgaggttttccagggactttaaaacctcagcaaagaatagttttaaggactcctcccccatttccattaaagcagatggagcataggcacagtgcaaacattccatatctcgactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgttcagaaacaagtctttcattttctttgtaagtttggctctgttggctgtttacacccatgaattttggcatgggtatctatttttcttttttacattg

SEQ ID NO: 7077 - DNA, 1593 bp, Homo sapiens
acttctgcttgcacttaggcgacctcgggagctcggactcctacgcagtcaccgggaagggccgccgccccgcccgcggctgctggcccgggtgacgcttccgcctgctataagagcagcggccctcggtgcctccttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgttcagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaa

SEQ ID NO: 7078 - DNA, 1294 bp, Homo sapiens
agtctaacttgccactctgtgaacttcactactggaaagcaacaaaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtctaattctctcaaatcaaccagccagactctaactgtaccctcagcattgccaacaggctctacgggacaaagacgatggcatttcatcaggaaaagtcgcaaatctctttggaaagagcacaattgacccttcatctgtaatggtcctggtgaatgccatatatttcaaaggacaatggcaaaataaatttcaagtaagagagacagttaaaagtccttttcagctaagtgagggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaa

SEQ ID NO: 7079 - DNA, 1125 bp, Homo sapiens
agtctaacttgccactctgtgaacttcactactggaaagcaacaaaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaaggctttgttaatcatggaaaaaggtagatttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccagctgaagggcttcaactttgcttggatttttaaatattttccttgcatatgtaaatagaatgtggtgagttttagttcaaaattctctgttgagaataataaatgcatgaaataccttaaa

SEQ ID NO: 7080 - DNA, 1731 bp, Homo sapiens
agtctaacttgccactctgtgaacttcactactggaaagcaacaaaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtctaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaacgattaatgcttgggttgaaaataaaactaatggaaaagtcgcaaatctctttggaaagagcacaattgacccttcatctgtaatggtcctggtgaatgccatatatttcaaaggacaatggcaaaataaatttcaagtaagagagacagttaaaagtccttttcagctaagtgagggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaaggctttgttaatcatggaaaaaggtagatttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccagctgaagggcttcaactttgcttggatttttaaatattttccttgcatatgtaaatagaatgtggtgagttttagttcaaaattctctgttgagaataataaatgcatgaaataccttaaa

SEQ ID NO: 7081 - DNA, 5219 bp, Homo sapiens
accataaccgtctgcagcgacggcggcgcagcgccccagtcgcggcggcgggacctgccgggacccttgcccgccgcgcacccgcagtcaccgccgagcgggcggccgggccgggacccgcgagtgtgcaccggcggccgggctggcgccgagcccagagcggaccagcagcagctcaagcgctgcggccgccgcctccccgctgaccccgcgatctgaggctgtcagagatgactctggttctgtccatgaatagattctgcgagcccattgtctcggaaggagctgctgaaattgctgggtaccaaacactatgggaggctgacagctacggaggcccaagccccccagggccagcacaagctcctttgcagggagaccggggagctggtcccccactggcaggatcacattacaggggaatttcaaatcctataacaacatccaagatcacatactttaagaggaagtatgtggaagaagaggattttcacccaccactcagcagctgtagccataaaaccatctcaatttttgaggaacgagcccacatcctttatatgtccttagaaaagctaaagtttatcgatgatcctgaagtgtacctccgaagatctgtccttataaacaatttgatgaaaaggatccatggagaaattatcatgcagaataactggtgcttccctgcctgctctttcaatggcacctctgcccaagagtggtttatggctcaagactgcccttaccgaaaacgaccacggatggccaaagaggaatgtgaaaagtttcatgcctgctgcttttaccaagaatgtggtggccactacctaaatttacccctttctgtcaatgctaatgttggaagtgcctccactgctgcctcctctccctccgcctcttcttcctcctcatcttcctcttcctctccccctttgcctttaccgagttgttcccgccaggtggattttgatgtaggtagtgcatctatttacaagagtgatggccagatacctgccaatgaaatctttgtcactaatgtcagatcacttggtgttcaggaaaaggccaaattaaatgatgagaaagcaaatgatgacaccaacagagatggtggccccctcagccacgaacctgtgggaaatgaccttgcttttgagtgcaaaggccaattttatgattattttgagaccggatataatgaaagaaacaatgtaaatgaatcttggaaaaagtccttacggaaaaaggaggcttcaccaccaagtaacaaactgtgctgcagcaaaggaagtaaaatatgagccatcttctcaccgaactttgaagcatgcacagcatgatcagttagctctcgtaaattttattttgaatggattttgtagttttgtacaacagataaaattatgccatgaacatgccatgtcgttttaatgcctggagagcagattgcgtaaaacatctgtatagcaggcatcagcgagcttcttataaatgtggtgatttttaccaaggaaacgattgacttaatgcttaaaagtatatcatagttttcttacggaaaagatcagtagatgagattgggggacaatgtgcccttgcaatatttccattgccccccaaggagcctgtcactagctaagaaatttctacatgtttgccagttaattagggagttatttggtaagcaaatcaatataaccagcaaagatacctgcttcttctatatgatacaatattttttttaaataaaagactaaagacagggagctagatgaaatggcttaatggtgctgttaagtatttgtacctaacagtcttgtgtgacagatgaaaataggatgtaacataatgaaacacacctgtctaggggcggcaatcaacagtcttacacagagagggtattccctgcaagtttctggcttgcctgtgatgggtgatgaggcttttagagaggtgttatacagggcgatttttggtgccttacttttatcttaatttttgccaatgtgaaaattaaggataaatcagagttacagcagggatttaacaaacaggacaaaaaaaaaaaaaaaaaaaaaaccacagggtggatcaatatggtttggaaactgttaactttgaactattgtgttcagcttttgattcgacatctctattctttatttttgatgcccaattgcttttggattcgccgttttttcaatagggatggaggaaatgagagagagagctgttagaaagcagcacgggctgctcgagcttttctatggcaactgtgtgttgctggggttggggttttctgggttttgggttgttttgttttgttttcttgtccaatgaagttcacgaaccagtggcatgcattatacttttctctgttttgcatcatttcacttgtttagattataaaagcatgtgggtttttatatatgaactttgctgttgattaagaagcacaatgttaataaatgatgtggtgatcaataaggtttatcttaaagaatgtaaagactttaggtttttgaaagttattttggagaaatgggacttaatctataatagttactatgtatttggtctacattttccaaataatatctttaacttgtacatttgaaaagtgttcagagtggccctcctaccatccttccttccactccagccaactcttcctgctaaactgtattccagtttccaagtttactaattgacttgggcctgttcaaataatacttcacagaaaccaaatgccaaacggaggaaataagtaagccctcccagtttctccaagataaagctttttttattattgctattaatattaaatataggtctcattcatacagtgtatgagtaggatcatttggacaattgtccacaaagaccaatttttaaaacattttcttgtgttatagttaaatagtctagtaatgttttgtcctttattttcaatatttgataaacatttgatgttcaaaacttagctaatagatgcttgtatatgaatgtgttgtaataaagtgaggttttcttgatatatatttattaagatgataaaaattcattaagttttttaaattttaatggctattggctatgtttctcttttccattattctctctcctttaaaaaactcaaaacatctagaaactgtagtggatagtggccacacaggagttttctaaattaaagagtattttaaaatgccaatctgacaggtgtttcagaatgatcctagttcgtaagtttaagtttctattgattaagaagcacaatgttaatagatgatgtggtgatcaataaggttatgtctgaaagaatgtaaagattttcctttctggagtgtctctgaaaaaaattgtataacacgaagccataaatactgaatcttagctgattgcattatgaactgtcaaactgtgaagatgacccatatgtaaacagttataacagctacagattattgctagtagcattccatacaattccatattaatgttcttaggagctaatatttgataaaggggaaagctagttaaaaactaattaatttgtcaaatgtagcattcttattatgagtgtaatatctcatggagatttaaatatgaacgaaaggacttatccttctgctttttaaaagccccagcattactagatagtgtttttcttgaaggccaaagctgtaaaatgacaaagttggtgattttcagcagcactcacctgagctgtgagcgcctgcacctgttcggtagaacccactagaatcacttctctgtaggataagtgatgcctttgaatccagcagcataaaaatctgttctttttagtcatcaagtttttgtttccaggatatttctagcattgcaaaaaaaaatttcttcaccaaacactaattcctaaacacccatccaaaccacaaaaattctcttgttagtaggcgagagtgctaggacttcctgtgttcacctcccatgcacccagcattgtcttttatgcatgagatattccattagattttcctagagtggccaggacacccttcatagtaagttatatctcttaactggattctatagttttatctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaagacaacagaaatttagaacattttacatgcttctttgttaaatggtgaagcaagggaatgaaagtatttatttttagagctcatagttaactccatcaagacatggctacccacccctccagttatgaacttgtattacagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatatccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactacaa

SEQ ID NO: 7082 - DNA, 732 bp, Homo sapiens
ggcggaggccgtccctgaggaagtaggagaagaccactagggctgtgtctaagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgc

SEQ ID NO: 7083 - DNA, 562 bp, Homo sapiens
ggtcctgcctcttccccgccatcttctgtcagacaaaaggacttagtttttctatcagtgtctcacatggaaggttcaagaggaggctcatcagtgtgaaaatccaaatcttaagggactgtacataatggagtaaacagaacatacgggtgtccgaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgc

SEQ ID NO: 7084 - DNA, 566 bp, Homo sapiens
agaggagaaagaatgtgaatgctcattgctggtcatttttttttcctgtgctatgccatcttaattgttcatagctcttctcttttaagaaagcttatgtgagagccacaattgtatcagagaacattattacataattatacagccttccctttcccttaaatggtcctttaaggctttacatctgcaatagagatagcttagtgaatattcttccaaataagtttttttagtttcatttttagattagccttttgtatttgcgtaaaacagtgcttttggtaaatgttgtgtatttaaggggaagaacaggatacttctgggggctgaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatatt

SEQ ID NO: 7085 - DNA, 1548 bp, Homo sapiens
ggacgcgggtagccgtctgaggtgccggagctgcgggaggatggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgcca

SEQ ID NO: 7086 - DNA, 1463 bp, Homo sapiens
gaggtggatttgagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgccatc

SEQ ID NO: 7087 - DNA, 997 bp, Homo sapiens
atggaggaggaccgggataaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgcc

SEQ ID NO: 7088 - DNA, 4303 bp, Homo sapiens
ggagcggggcgccaaggggcgcgccaggagctgcgcgggcgctgggagggagaccagggcgcagttccgggcgcgtctgagcggttctcgaggcgttctcgcctcggtctctggcgagtgcacggatcaaaagcagcatggatctgcctgtggatgaatggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacctgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagcggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctacgtggtggaggttcgccacgggccgtccagtgttgaaatgggccatgagctcttcaaattggcccagatctttttcaacgggtttgcagtacccgaagccctgagcacaatacagaaagctgaggaggttctgtcgctgcactgtggcccatgggacgatgaaatccaggagctccagaagatgaaatcctgtttgttggacttaccacccacccctgtagggcctgcattgtagggttccaggaggattttgacccacagaaaaggagcccatggaacacaagttaaagaggttttgctggccaggtatggtggctcacgcctgtaatcccagcactttgggaggctaaggtgggcggatcacctgatgtcaggagttcaagaccagcctggccaacatggtgaaaccccatctttactaaaaatacaaaaaactagccaggcgtggtggtgggcacctgtaatcccagctacttgggaggctgaggcaggagaatctcttgaacccaggaggcggaggttgcagtgagccgagatcgctccactgcactccagcccaggtgacagtgtgagactccatctcaaaaaaaaaaataagaggccgggtgcggtggctcaagcctgtaatcccagcactttgggaggccgaggcaggcagatcacgaggtcaggagatccagaccatcctggctaacacggtgaaaccccgtctctactaaaaatacaaaaaaattagtcgggcgtggtggcggacgcctgtattcacagctactcgggaggttgaggcaggagaatggggtgaacccgggaggaagagcttgcagtgagccgagatcgcgccactgcactccagcctgggtgacagagccagactccatctcaaagaaaaaaaaaaaatattaagaggttctgctgccagatgtgggttctgtgggtcgggtgtgggttctgtgggtcgggtgtgggttctgcagaccaggtgcggattctgtgtaggttctgcaggcccagtgtagaggctcacacctgtaatcccagtactttgagacgctgaggtgggaggatcacttgagcccaggagttcaaaaccagcctgggcaatatagtgagaccgtatcactacaaaaaagtttttttagttcaccgagcatggtggcacatgcctgtagtcccacctactcgagaagctgagatagggtcacctgagcctggtaggctgaggctgcagtgagccaagatcgcactactgcactccagcctgggtgacagagtaagaccctgtctcaacaaaaaaataacaggttctgttgctgctgagctttcgtcaggaagataagactttcccaacagtccgaagcctaggatatgagggctgaggaggactcaaaccgttgcagtcagagagacacctattttggtgaatattttttgaaatagttaagtggcctccagtacaaactcccagttcccagaaaagacttaaaactagtatctggagattccaagtcctttaaaaggattttagctgatctgcaggcatctggatgttagcctggggttttggctggattccacctcgctcagtgatgatagtctgtttccctggaacattcctgtggttttagtagtaatgagatgtgtgcaccactccagtgggaactgaagctcttagtagttacattgtaattaaaaaagaattataaaacaagaaatcagcaagcctgcttacctccagagacacaccgttccacttacagtatctagcttcctcgactcctttgttaaaatcgtggagtatgaaccgtgaccagagaagtaaatatggagccgttttattgagcagtttcctccagggatgacggctgtcagtgtgtttcctgccagttttccagtccttactctctgcccttcattctgtactcttggcagagtcagtaaccaaccactaataaaatcaaagttgtagtaaagactttataacacata

SEQ ID NO: 7089 - DNA, 3069 bp, Homo sapiens
agatccggtcggctcggagcccagggctccagccgggctactcacgctccggaggcggagcttcagcagcgggagggggaggaatctggggcctcccaatggcagctcgggtgtcttccatcgcagccattcaacgtctggcgacggtcaaatttaaacacccctcccacctcctccgccgggacctgtcgggaaagcgtttgcagttattgcggcggctggacacgccccgccgccgaagaggcgggagaagggcggggcctttctccgagttggcctatcactacgggcagcctgcggagaggcgggaggcggcgccaatcggggcgagcagctggagcccggcggagcagttggctgagttgttgcaacttttttcgaaagctgggtttcccgggagatcccaggcggtgacagagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaacaaggaaataaacttgaaaattatttgtcatcataaaaatgaaacaaattaaaatatttattgccaggc

SEQ ID NO: 7090 - DNA, 3140 bp, Homo sapiens
agatccggtcggctcggagcccagggctccagccgggctactcacgctccggaggcggagcttcagcagcgggagggggaggaatctggggcctcccaatggcagctcgggtgtcttccatcgcagccattcaacgtctggcgacggtcaaatttaaacacccctcccacctcctccgccgggacctgtcgggaaagcgtttgcagttattgcggcggctggacacgccccgccgccgaagaggcgggagaagggcggggcctttctccgagttggcctatcactacgggcagcctgcggagaggcgggaggcggcgccaatcggggcgagcagctggagcccggcggagcagttggctgagttgttgcaacttttttcgaaagctgggtttcccgggagatcccaggcggtgacagagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaacaaggaaataaacttgaaaattatttgtcatcataaaaatgaaacaaattaaaatatttattgccaggcaaggcca

SEQ ID NO: 7091 - DNA, 3015 bp, Homo sapiens
gcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagacccta

SEQ ID NO: 7092 - DNA, 1212 bp, Homo sapiens
gacagagggcttcaggcacgcggctgctgctgccactgctgctctgagacaaggtggatgagtctgctgccggatcaagaaaaagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 7093 - DNA, 1208 bp, Homo sapiens
gttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 7094 - DNA, 1160 bp, Homo sapiens
gaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaa

SEQ ID NO: 7095 - DNA, 1165 bp, Homo sapiens
gcggccgccggcgcctaggtgagctagtaggacttccgggtcgggcctccagttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 7096 - DNA, 3258 bp, Homo sapiens
gggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctggtgggtgttagtcacacattttagactaaggtttgatggactaaatttatatagtttagagtcgatgagttgtgtctactcaacaattaggaacttaatccttttccttttgcttttcctacagaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagacccta

SEQ ID NO: 7097 - DNA, 4272 bp, Homo sapiens
ttcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgtcggaccgtaggacggcctcacggctagagtttgaggactatgggggcggggacggtgcctgtgtctgtggcggtcaccgggcttcacgtggtcctcagcagggtgatggtggacagctcgcgcgagggcccgggagtcttggggacacttcccggcgcggtctgtggactgagcgctgggacccgcaccgaaccagccgccgttcgcctctggagctggacatgccgactttcgttaggtcaaataatgaaccttatactgcggaagtgcggtattaatattgcctggagttcttgtctcttgctcatttctgccctcgtatgttttagaagtagatttattttttatttttatttttttaatttattttttgtgacagagtctcgctctgtcgcccaggttggagtgcagtggcgtgatctcgtctagctgcagcttccgcctcctgagatcaagcgattctcctgcctcagcctccccagtagctggtattacaggtgcctgccaccacgcccggctgatttttgtatttttagtagagacggggtttcaccatgttggccaggctggtcttgaactcctgacctcagcccgcctcgggctcccaaagtgctggttttacaggcgtgagccactgtacccagccattattttatttttatttatgtatttatttttttatttttttgagacggagcctcgctctgtcgcccaggctggagtgcagtagcgcgatctcggctcactgcaacctccgcctcccaggttcaagcgattctcctgcctcagcctcccaagtagctgggattacaggcgtgtgccaccacgcctagctattttttgtatttttagtagattaagctgtagtcactaggtctgcaagataaaactgttttagagggactgatataatgggaattctgttactgtagggatcatgatttagctcacagtataaacgtttcatgtacaaaagcacttgagagaaacagtttaccaaaacatacatttgtatacttaaaggtacaaagaacagtgattatcatataactggaaagtaaatcaaagaaatgttttttattttagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctggtgggtgttagtcacacattttagactaaggtttgatggactaaatttatatagtttagagtcgatgagttgtgtctactcaacaattaggaacttaatccttttccttttgcttttcctacagaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagacccta

SEQ ID NO: 7098 - DNA, 796 bp, Homo sapiens
cggccgccggcgcctagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacc

SEQ ID NO: 7099 - DNA, 745 bp, Homo sapiens
gttgcccgggtaacgggagcagagtcggcgggaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctg

SEQ ID NO: 7100 - DNA, 431 bp, Homo sapiens
cgggagcagagtcggcgggaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggg

SEQ ID NO: 7101 - DNA, 707 bp, Homo sapiens
ctgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgtcggaccgtaggacggcctcacggctagagtttgaggactatgggggcggggacggtgcctgtgtctgtggcggtcaccgggcttcacgtggtcctcagcagggtgatggtggacagctcgcgcgagggcccgggagtcttggggacacttcccggcgcggtctgtggactgagcgctgggacccgcaccgaaccagccgccgttcgcctctggagctggacatgccgactttcgttagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatcc

SEQ ID NO: 7102 - DNA, 754 bp, Homo sapiens
gggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtg

SEQ ID NO: 7103 - DNA, 4786 bp, Homo sapiens
ggcagtaccagggattagggtctgggctggaaaaatcctggtgttttgaatatgttcaggtccagttcagactcttgatcccacagccacttcttgagtgagccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgcggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaa

SEQ ID NO: 7104 - DNA, 6827 bp, Homo sapiens
gctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 7105 - DNA, 6866 bp, Homo sapiens
gctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgcggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 7106 - DNA, 6582 bp, Homo sapiens
ctcgagtcctgccgcctcccgggagtgccgtgcgccgcagcccgggcccaggccccggcagcgcctgggacaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 7107 - DNA, 921 bp, Homo sapiens
gctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcacctta

SEQ ID NO: 7108 - DNA, 2318 bp, Homo sapiens
taggtgtggtctgggaaggctggggcggtggcaaggtggagggcgggggtgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctct

SEQ ID NO: 7109 - DNA, 1978 bp, Homo sapiens
agcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggttcgtggggagcagggactggaggaagctggagtgcgggtgactgggaagactggagaggaggcgtgctcagatctcttctcccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctct

SEQ ID NO: 7110 - DNA, 3487 bp, Homo sapiens
aaagcagccgtgccgtgtcccagggcgggaattgtgcggggacgggctccacggaggaatcttctcttccttcccttgatgttgccagaggactcaggaggctctccagatgctgcagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcagcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcatat

SEQ ID NO: 7111 - DNA, 3983 bp, Homo sapiens
actaacagatcactcgacacctaccagcccaggcagggctgggactgggcatttcctggctgagctggaggcttgggcccttcccattgtctcagaaccccaggtgatgccaagacatgggctctcctgggatgccgtgcttggtgacccaggagaaggactagattgctcctggtggttgctcccccttgcagagtcccacctgcccctttgggtcctgttgcctggcctcttttgctgtcctgggtagaggagatgagttcgtcgctggctgcaagctgaggccaactgacaatgctgcacagagaaggggcaccgagagtggccccggattgagcagtccgtagtgcagagcagcccctcgggcgttctgcctggccctgcttcccctgctggctgcccttctggtgcgtgcatcccaggtggcatcatgctgcagcagatcctgcacgacatgtacatcgaccccgagctccttgccgagctcagcgatgtgcagaagcacatcctcttctacaaaatgcgggaggagcagctgaggcgctggaaggagcgggagacttgggaggccctggcccaggacgagggtctcaggcctccaaagaccaagcgagcagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcatat

SEQ ID NO: 7112 - DNA, 953 bp, Homo sapiens
cccctttgggtcctgttgcctggcctcttttgctgtcctgggtagaggagatgagttcgtcgctggctgcaagctgaggccaactgacaatgctgcacagagaaggggcaccgagagtggccccggattgagcagtccgtagtgcagagcagcccctcgggcgttctgcctggccctgcttcccctgctggctgcccttctggtgcgtgcatcccaggtggcatcatgctgcagcagatcctgcacgacatgtacatcgaccccgagctccttgccgagctcagcgatgtgcagaagcacatcctcttctacaaaatgcgggaggagcagctgaggcgctggaaggagcgggagacttgggaggccctggcccaggacgagggtctcaggcctccaaagaccaagcgagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagtgtgagtagagcttgtgcctcaggcagggagaccagtcccgcctccccacccacctcctcccaatgctgatgtactcattcgtcatttc

SEQ ID NO: 7113 - DNA, 1296 bp, Homo sapiens
atgctgcagcagatcctgcacgacatgtacatcgaccccgagctccttgccgagctcagcgatgtgcagaagcacatcctcttctacaaaatgcgggaggagcagctgaggcgctggaaggagcgggagacttgggaggccctggcccaggacgagggtctcaggcctccaaagaccaagcgagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcaggacctgggagcgcccgctgcgcccagtctccagagatgtcatcgtccgctggtttaaggaggagcagctgcctcgccgagctggcttcgagaggaacaccaagttcatcgccccctggttccatggaattattagccgagaagatgcagaagctctcctggagaacatgactgagggagcattcctggtccgggtcagtgagaaaatctggggttacaccctctcctaccgcctgcagaaagggttcaaacactttcttgtggatgcttctggggatttttacagcttcctgggagtggaccccaatcgccatgcaacgctcacggatctcgttgatttccataaggaggaaattatcactgtttcaggaggagagttacttcaggaaccctgcggacagagggacagcccaccagactaccatctgttgtttgaataa

SEQ ID NO: 7114 - DNA, 3705 bp, Homo sapiens
actcacaagggccgggcccgaaccaccctgagcgcctcctccgagccaggctcgatccttcacactgggaacggagacactccggtccagtgtcacttgtcctcgagtaagaggagagggatgacaggcgagcaacggagtcacaagggctctgcagagaatgaagcgtgagtggtggtcgtggaaggcttcccggaggaggcggtgcggtagccgcggctcggatgacgcggaggagccagccagagaggggaggggcagaggccctccaggaggagggacccgtgagtgaggcgcgggggattcagcgcccccagcccgggaggaggtgccttctgagctccgggcgagcccctcccgcccttccaggcggagcgccgggcgtgggcagtgccagggcccctcgcggccgctgattgggtggtgcggccgagcggagcggctccgcgggcgccgattgtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcagctctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcggatgacctgctgtgtggcttcggatgctttgggacttctgggcttctgctttactcctggggcaggagcttgttcacggcaaagctgcagccctctcctaaggaggctaggccttggggcgctgactgggagtctccagaaagagggttttggggaggcaggagtgagcttttactctgggcaaagacctggagtgagccaccctgtctatgagagcagagatgactccatggagcttgtgggcaggaggctggggatgagccccatctaggctgacagagcagggctgtttctcatatgtatctgagagtgaaggaggggtgggaaggtgcagagagggcaggagggacagagggctgtacctaacgctcacgcacggtggactcctgtgtgcagaaagggatgcgcaccagcagacagggccaagaatctccatgctgtctccactcaaaacctcagggctgtgactcccgctttctcagaagggatgcgcaggctcaccccttccccctaggaatcaccagggcacccccacccccagctcatctcctttagccatttgacagggaggggccagcagtgagctgcaggcttagaggggtgaccagggcccttcctaactcgaccgcatgtggtttggtggctgccttgggagggaggctgtccgatgctgacattccccttagcatggccctgaccgtggctgtcaggggccaccttgcctcaccaggccagccccactgggaatggggtcagtcacagcagaaccgtcgaaaggtggacctgatgtgggccctgccgggggcgcttggcctcagcgggccatgggagacccagggaaacgactctagtgtgaggcagtggtcctgccagtgactgacaaaccctctttgtaagcaaacttgacaaataatgaatctactgaactctgttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcacaaaagatagaaggaactgccctttgggacttcttttcactggaaacccagcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgcttc

SEQ ID NO: 7115 - DNA, 1934 bp, Homo sapiens
gagtaagaggagagggatgacaggcgagcaacggagtcacaagggctctgcagagaatgaagcgtgagtggtggtcgtggaaggcttcccggaggaggcggtgcggtagccgcggctcggatgacgcggaggagccagccagagaggggaggggcagaggccctccaggaggagggacccgtgagtgaggcgcgggggattcagcgcccccagcccgggaggaggtgccttctgagctccgggcgagcccctcccgcccttccaggcggagcgccgggcgtgggcagtgccagggcccctcgcggccgctgattgggtggtgcggccgagcggagcggctccgcgggcgccgattgcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcagctctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcgg

SEQ ID NO: 7116 - DNA, 564 bp, Homo sapiens
tcactttaccccccatgccgcctccaccaccccagctgggtgcccccagagggcgggcaccttcgtccaccggcggcggggcctgacacacagtcagcctcggaaacattccaagaaggaccagagctacgagcaccccaggagcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagc

SEQ ID NO: 7117 - DNA, 511 bp, Homo sapiens
agtgccgtggctggagctgctagcccgattccccacctaaagggcccgaaggatggggccacggcccatgtgcgcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtcca

SEQ ID NO: 7118 - DNA, 524 bp, Homo sapiens
ctcctcgtggactggcagggacccccaccaaactccaagagtggacaccctacttatctgtgggaggggagtccgagcagaaaggcaccgccatggcctgaggaaacagctccagagacatggatttgcttccctgctctcccactgaagctgtgtgactatggggccacctggaaaacctcagaggacagctccagcctcattccaagtgtgtccccttcggaaggtgctggcccagccagactccagtgtaaagcctcagaaaagcagcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttca

SEQ ID NO: 7119 - DNA, 894 bp, Homo sapiens
ggcattttccggtgcctgcaccaaatcaggaagctcctagtctgtgccccaagatcacgcctcatttggaggtcacacgaggcctggctggtgggtcctgccagggcactggatctggagagtggaggaagcactgggtgccggggtttgggctcggggccatgtacgcctcctcctaccccccacccccgcagctgtcccctagaagccacctttgcccacccccaccccaccccaccccaccccagctcaataatctgcttcttctagaaggaaggaaatcgtctcttccctctgtagcccccactgggagtgcctcagctgctgaggacagtgatctgctgactcagccttggtactcggggaactgtgaccgctatgctgttgagagtgccctgctccacttacaaaaggatggggcctataccgtgcgccccagctcagggcctcatggctcccagcccttcaccctggcagtgcttctccgaggccgggtcttcaacattcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgaatgaa

SEQ ID NO: 7120 - DNA, 1975 bp, Homo sapiens
gttggggccgtgggagatgaagatggtgggtggggggttgggcccacagcctgctaagcaggcagagtggcctcctgaacccttcctccatcgcctagagcaaactcccattcctggaaggaggagcagcccagaccctgagactggactaggtctgttagggtccctgtgtggccggcaggactcgtggtgaagcccggggaaggcctgggtcctccaggtcagggatgtaggtcccagggtgtgcaggccgcggtatctgaccatcgtcggcgccctgcgcccaggcatcaattttacatggcagagtcaagaatgccctcttggtcgagtgcagtggctcacacctgtgatcccaacactttgggaggctgaggcaggaggattgcttgagcccagaagttcaagaccagcctggacaacatagacacagaatggtctgcctgggcctcagtcacattggaggagcagagagagaaggagccatgaggagtcactcaagggttttaggcagagccgtgacacaaccagagatactacgagcaaaggttccggaacagggcagggcaggacaggtttgagagcaatggcgcgatttcggctcacagcaacctccgcctcctgggttcaagctattctcctgcctcaacaacctcctgagggctgggattacagacaagaggccatgtgaggacacagagaaagcagccgtttacaagccaagaagagaggccgcatcacaaaccaacctttatggcaccttgatcttagacttctagctccagaacagagatgcaaatgatgggaacaatggagcccttgtccccaggccatttgtggcagatcctgggctccagggaggcaaagctcctctgcctctgccatggacaagctcagtgggagcaggccccggctggggccaccgctcccaccccccagatgtgtggactccccaggttggagagaagatgctcccagcccttccttcctgcctgccccagggacttggagacacaaggcccaggaggaggacgaggaggaaaataagtatgagctgcccccctgtgaggctctgcccctcagtctagcccctgcccaccttcctggcactgaggaggactccttgtacctggatcactctggccccctgggtccatcaaagccatcgccacccctgcctcagcccaccatgagcagggtgcatcgtccagagtggtgccaggccctccaaagaaacctgatgaggacctctacttggaatgtgagccggatccagtcctggctttgactcagactctcagcttccaagtcctgatgccctcaggccctctgcccaggacatcagtggtgcccaggcctaccacagccccccaggaaactcggaatggaacagcagatgctgcctctaaagaaggaaggaaatcgtctcttccctctgtagcccccactgggagtgcctcagctgctgaggatggggcctataccgtgcgccccagctcagggcctcatggctcccagcccttcaccctggcagtgcttctccgaggccgggtcttcaacattcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagctgacaccctcttcctggcctccaggaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgaatg

SEQ ID NO: 7121 - DNA, 1896 bp, Homo sapiens
atgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccgggccagggcctggggacctggaaggaagttggaccaggtcttgtcttcaccccaagagagcctcagagcactgggagttgggcagagatggcagtgagtccccaaagggctgggggcctggtgcagtggctcacatctgtgaccccaacactttgggaggcccagctgtagagacggggtttcatcatgttggccaggctggtctcgaactccagacctcaagtgatccgcccaactcagcctcccgaagtgccacctcaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactag

SEQ ID NO: 7122 - DNA, 794 bp, Homo sapiens
gggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgca

SEQ ID NO: 7123 - DNA, 1050 bp, Homo sapiens
ggatccaagctattgtcctgcccatggcttcccatctcaggacgctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccgg

SEQ ID NO: 7124 - DNA, 2061 bp, Homo sapiens
gaggcgctctgccgccggcccctcctcacttcttcctccctggggatggatccaagctattgtcctgcccatggcttcccatctcaggacgctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggactctggcctggggacctggaaggaagttggaccaggtcttgtcttcaccccaagagagcctcagagcactgggagttgggcagagatggcagtgagtccccaaagggctgggggcctggtgcagtggctcacatctgctggtctcgaactccagacctcaaacgtcacctctcttctcacatttatttatttgtccccctttctccttccccccatgttcctcacactgtcatccccacctcaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaaggcaagtcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactag

SEQ ID NO: 7125 - DNA, 2107 bp, Homo sapiens
ggatccaagctattgtcctgcccatggcttcccatctcaggaccctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgca

SEQ ID NO: 7126 - DNA, 3277 bp, Homo sapiens
acttccctcctccccgcgctgcgagcagcatcctctgcagaccctcggtcctcgcgcccggggtcgtcccgctcctgcggctcagcgtggtggcctcccctcgcccgccaccccggcaactttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaaccatgaccgagatgagcgagaaggagaacgaaccggatgacgcggccacccacagccccccagggaccgtctccgccctccaggaaaccaagctccagcgattcaagcgctccctctccctcaagaccatcctccgaagtaagagcttggagaacttcttccttcgctcgggctctgagctcaagtgccccaccgaggtgctgctgacgcccccaaccccactgccccctccctccccaccacccacagcctcggacaggggcctggctaccccatccccctccccatgcccagtcccacgccccctggcagcgctcaaaccagtgaggctgcacagcttccaggaacatgtcttcaagcgagctagcccttgtgagctgtgccaccagctcatcgtaggaaactccaaacagggcttgcgatgtaagatgtgcaaagtcagcgtccacctctggtgctctgaggagatctcccaccagcaatgcccaggcaagacgtccacctccttccgccgcaacttcagttcccctctcctggtgcatgagccgccaccagtctgtgccacaagcaaagagtccccacccactggggacagtgggaaggtggaccctgtctacgagaccctgcgctatggcacctccctggcactgatgaaccgctccagtttcagcagcacctctgagtccccgacaaggagcctgagtgagcgggatgagctgaccgaggatggggaaggcagcatccgcagctctgaggaggggcctggtgacagtgcatctccagtattcacagccccagcagagagtgaagggccaggaccagaggagaagagtcctggacagcagctccccaaagccaccctgcggaaggatgtggggcccatgtactcctacgttgcactctacaagtttctgccccaggagaacaatgatctggctctgcagcctggagatcggatcatgctggtggatgactctaacgaggactggtggaagggcaagatcggcgaccgggttggcttcttcccagctaattttgtgcaacgggtgaggccaggcgagaatgtttggcgctgctgccaacccttctccgggaacaaggaacagggttacatgagcctcaaggagaaccagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacacccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaacccaactgagaacaaaatcctggcccgtgcttggtcaaagcaaacccatttcactgtcaggacccccggtcacacaggaaccacccgccaggggagcctgtgactgtcagttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtcccagccca

SEQ ID NO: 7127 - DNA, 1656 bp, Homo sapiens
ccctgtcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttagaaaa

SEQ ID NO: 7128 - DNA, 795 bp, Homo sapiens
tcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaaccctcccctttgaggaccaccctactgcaagggacagaaagggagagaagaatgaaagggattagatttcatagtggggtccaacctcttgcaggatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctct

SEQ ID NO: 7129 - DNA, 1580 bp, Homo sapiens
ttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttagaaaa

SEQ ID NO: 7130 - DNA, 10641 bp, Homo sapiens
ctctagaatacagacagttcctgctctaagaggccatctgtgaggctcagtctcccaacacctctgacacaggcagccatgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacggcaagttcctggatgaggagcggctcctgcgcgagtacccacagcccgtgggtgagggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcaggtggccataatagcaggcaactttgagctggcagaatacatcaagaaccacaaggaaacagacattgtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 7131 - DNA, 4226 bp, Homo sapiens
ctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggatgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttttttttgcaataa

SEQ ID NO: 7132 - DNA, 3171 bp, Homo sapiens
aggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagcaaagacctccctcttccggctccaggtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggatgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcggtcatctcaaccccagcagaagcagttacatgcattctgggctgttcttcctacctggtggcttttgtcatctgacctctgcctgccccgagtcttcactcctggccttcacctgtccccttaa

SEQ ID NO: 7133 - DNA, 617 bp, Homo sapiens
gggcctgggagctgcctctgaggaacacgccgcaggcgacggagcactgttccgggagcacggtctgttgggtgtgacggcccagcaaagaggcagtgaccggctcctgaggaggggcacaaggcacccaggggttctgcctcgacagggaaggggactccaggcagaaaaccagcgagaggaggccccgtggaggaagggagcacagcaaacccgagatagggaggggaggcgcagcagcggtgcgggatcacgcccaccacaacacggtgcacggtgcggtgaggggctcgctggatctgaaagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacgaggctcctcctgcccgcgtggctgggcctgctgctgggacccctccctgccagatgggggtttatcccacagacctgaccctgcagctgctggctgtgcggaggaaga

SEQ ID NO: 7134 - DNA, 3731 bp, Homo sapiens
cgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggatgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctacacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttttttttgc

SEQ ID NO: 7135 - DNA, 4293 bp, Homo sapiens
gggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggatgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttt

SEQ ID NO: 7136 - DNA, 2325 bp, Homo sapiens
cccccagctcctctgactggggcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcgccacgccggtctggtcgctgggggcggggcctgcgcgggggcagggcctgggcctccgcattcctgacggtccctcccaggcacatctggccaacatgtggctcccattaccgttc

SEQ ID NO: 7137 - DNA, 2428 bp, Homo sapiens
ccaggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggaggccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcgccacgccggtctggtcgctgggggcggggcctgcgcgggggcagggcctgggcctccgcattcctgacggtccctcccaggcacatctggccaacatgtggctcccattaccgttc

SEQ ID NO: 7138 - DNA, 2519 bp, Homo sapiens
ccaggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcgccacgccggtctggtcgctgggggcggggcctgcgcgggggcagggcctgggcctccgcattcctgacggtccctcccaggcacatctggccaacatgtggctcccattaccgttc

SEQ ID NO: 7139 - DNA, 2206 bp, Homo sapiens
ccagctcctctgactggggcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaagaacgggcagctgggagccttcccatccaactttgtggaattgctggacagtgggcccccaagccttggtaacccagacatgccttcagtcagccctggtccccagcggcctcccaagctgagcagcctggcctatgacagccctccagactacctgcagacagtctcccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcg

SEQ ID NO: 7140 - DNA, 2649 bp, Homo sapiens
atgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggacgagattctgacggtgctcaggagagtggatgagaactgggcggaaggcatgctgggagacaagatcgggatcttcccgctcctgtacgtggagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggatgtctcctcctcggcgggatctacccccacggctgtcccacgggctgcctcggtgtctggagagcagggcacgcctcccaaggtccagctgcccctcaacgtgtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaagaaagagaagaagagtgggctcctgaagcttctagccggagcatccaccaagaagaagtcacgctccccgccatctgtgtctccaacccacgacccccaggtggccgtggacgccctgctccaaggtgcagtgggccccgaagtgtcctcactgtccatccacggcagggcagggtcctgccccatagagagcgagatgcagggtgccatggggatggagcctctgcacaggaaggcaggctccttggatctaaacttcacatctccttcccggcaagctccgctgtccatggctgccatccgccccgagcccaagctgttgcccagagagaggtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctga

SEQ ID NO: 7141 - DNA, 2341 bp, Homo sapiens
ccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggacgagattctgacggtgctcaggagagtggatgagaactgggcggaaggcatgctgggagacaagatcgggatcttcccgctcctgtacgtggagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggatgtctcctcctcggcgggatctacccccacggctgtcccacgggctgcctcggtgtctggagagcagggcacgcctcccaaggtccagctgcccctcaacgtgtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaag

SEQ ID NO: 7142 - DNA, 3128 bp, Homo sapiens
gtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctgagaactggtgctccctgcacccagctcacagagggggaggccgcctgggaagctccacggcacacagagagggagccatggcgccccaagggttccaggtcatctccaaggcacctggcgggggataccctggcccagggtgggggccagggactgtggaggtcgtgccttctcccaaaacccccaaacggagagcacacctgggatgttcttcaaggaaatgcccaccccctctgtggaaactgcaaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaataatgacttggttgagcttgaaagaaaagatgtctgaggcgacatcaaaggggcagaatttttatatttcccatatggctttgggagagcgccgagaagccgccatcccgcacctcagcgctggccagtactctgggggctggcggggtggatccattgagggggtcggagggagcttggaagcagccggtttctttaaactcttaccaaaaccccgcgctctgtctagacggtgatgattattattcaagacctggaaacatttcgaggaagggccactataattgtccttttgtgtggcggtagaaggagcacgcaggtcaaccccagccgggaaggcaaaatcttccctttattgcctcagagagaactgcaattagcattctcagaagatgatttcttggtatcaaaatgtgcagtttctacaacagtttagatcaccaccaccatttttcttcttttttaaaaataaataactgctcccatttcaggcagtgcaaaccttcatctgctggagaccagaggtacaaggagatcagggggttgcagcaccgctgcaggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggtcaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggccctgcagccttcatgatgatgtagctcgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatgg

SEQ ID NO: 7143 - DNA, 1763 bp, Homo sapiens
ctccttgtccgcggggcggggcagcgcgccttcctcttcctgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaat

SEQ ID NO: 7144 - DNA, 3540 bp, Homo sapiens
aagaggcttcattagtaatgacctgtgtcttcatcagtatgatagaatgggacatcagcactctgatcaggtcatgctctatatgccttatggtacagcagaggaaaaatgggtgagccatcatttgatgctgaggatgggatttgaggcttatgtctaaatttttatttgcatattctttttgttctgacagagaaattcactgcatgtaactatgaccacgcatgattttatcagaagttgattagaatctgtaacattttctgtagttcagctgacacactgaagatgtcctcactgtgaccagccttgtcaacagctggatcacagtgacataagctgtgtctaggatgagtcttgcggtctgcagccgtgtgaggctgcatctgattcccaagtccaatggctctcttcccgtgtttacagatcaggccatgacctttccctacagcaggatgtttgcaagattaactctcaactgaggaatttgcttatttgctctaatactgcttggttgagagagttcaaagtagaaagtcttctgaggggataagattcatgtattatttacagtgcttcagttgcatgtatcagaaaatctagtctaaattgctttaacagaaaaagatgttgctggtccatttgacgaagaagtccagagcggcttgtgacttcagtctggctttgcagagcccaggtgctctctccaccttctgccaggttcccctatgaaggctttgctctcagactctccccttgtggagacaaaaatcccacagcaagtggaaacagaagtgccttggaaaaagttattctggcagctcctatacaagtcccccatcagatgctggtattggaccagctttggttataaagccctgctgtggcaccaaaaggaatgtcgtcctgatacagcagcctcgggtcacccaatccactccagatactatggctgcagcatcaatgtaagcagacaagttgtgctgcctctgaaataaagtagatgaaatattcagcagcagaaagaacaagtttccactccagtgaactaattcaaatgtatccagcatctagatatatgtataaatgtaattaaaacatattgagcatctagagcatctctcccaagataattaccacctgatagtaatggctataaaagctaaaagtggaatcagtctacatgtttcgcaataggaatcaattgaagcatacatcaaaatgcagacagtagtattgatggagtttcgttcttgctgcccaagctggagtgcaatggcgccatctcggctcactgcaacctccaccttccaggttcaagtgattctcctgcctcaggctcctgagtagctgggattacaggcgcacgtcaccacatctggctaattttttgtatttttagtagaaatggggtttcaccatgttagccaggctggtcttgaactcctgacctcaggtgatccccccacctcggcctcccaaattgctgggattacaggtgtgagccaccgtgtccggccataaaacatttttttacaaaaggcttacaaaggaatatttatagcagttttatttgtaatagccaaaagctggaaacaacccaattgtctatcaacagtgactggaaggacaaattgtgctatgtccacacattagaataccagttggcagtcaaaaaggaagagctgatctgtgcagcaatttgagtctcagtaatttcatgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagagactgacgagacacccatgaatgcttccttttctgtaaaatgggacaatgacaggacctgtaaccacacagggttttcctttcaagcacatagatggcacacacgtaatcgagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttact

SEQ ID NO: 7145 - DNA, 1279 bp, Homo sapiens
agtgcgcctgcggaggcggtcctatgacgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgttttt

SEQ ID NO: 7146 - DNA, 1682 bp, Homo sapiens
ctcttcctgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaa

SEQ ID NO: 7147 - DNA, 2064 bp, Homo sapiens
cgaaggcctgagcgcggcccggcgggcgcgtggtttttgtcccgcgaaacgtacacggcgggtgttttgcgccgcctccttcgtcacctgccgcaggaagtgtggaactggtctcaatcggttgaccaccttaaggaaataggatttacactgtggacagagatgtgtcctttacacttcatttgaaccaatatgcccatgctcctgtggaggctgagttggaaagtgacacgaagctgcccccccgcaagagagcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgttta

SEQ ID NO: 7148 - DNA, 1414 bp, Homo sapiens
atggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttc

SEQ ID NO: 7149 - DNA, 494 bp, Homo sapiens
agtgcgcctgcggaggcggtcctatgacgtgtggaactggtctcaatcggttgaccaccttaaggaaataggatttacactgtggacagagatgtgtcctttacacttcatttgaaccaatatgcccatgctcctgtggaggctgagttggaaagtgacacgaagctgcccccccgcaagagagcaggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtc

SEQ ID NO: 7150 - DNA, 1085 bp, Homo sapiens
gccggcggccggagggtcaggagggccttggaggagagatgcccggcaaacagtctgaggaagggccggcggaggcaggggcttcggaggacagcgaggaggagggtctgggcggcctgacattagaggagctccagcagggccaggaggctgcccgcgcgctggaggacatgatgacgctgagtgctcagaccctggtccgagccgaggtggacgagctctacgaggaagtgcgtcccctgggccagggttgctatggccgcgtccttctggtcacccatcgtcagaaaggcacacccctggcactgaagcagctcccgaaaccccgcacgtccctccgtggcttcctgtacgagttctgtgtggggctctcgctgggcgcgcactcagccatcgtgacggcctacggcattggcatcgagtcggcacactcctacagcttcctgacggagcccgtcctgcacggggacctcatggccttcatccagcccaaggtgggcctcccgcagcccgcggtgcaccgctgcgccgcccagctggcctccgccctggagtacatccacgcccgcggcctggtgtaccgggacctgaagccggagaacgtcctggtgtgcgacccggcctgccggcgcttcaagctgaccgacttcggccacacgaggcctcgcgggacgctgctgcgcctggccgggccgcccatcccctacacggcccccgagctctgcgcgcccccgccgctccccgagggcctgcccattcagcccgccctggacgcctgggcgctgggcgtcctgctcttctgcctcctcacgggctacttcccctgggaccggcccctggccgaggccgaccccttctacgaggacttcctcatctggcaggcgtcgggccagccccgggaccgccctcagccctggttcggcctggccgccgcggccgacgcgcttctgcgggggctgctggaccctcacccccgaaggaggagcgctgtgatcgccatcagggagcacctggggcgcccctggaggcagcgggagggcgaggcggaggcagtgggagcggtggaagaggaggctgggcagtga

SEQ ID NO: 7151 - DNA, 1047 bp, Homo sapiens
atgcccggcaaacagtctgaggaagggccggcggaggcaggggcttcggaggacagcgaggaggagggtctgggcggcctgacattagaggagctccagcagggccaggaggctgcccgcgcgctggaggacatgatgacgctgagtgctcagaccctggtccgagccgaggtggacgagctctacgaggaagtgcgtcccctgggccagggttgctatggccgcgtccttctggtcacccatcgtcagaaaggcacacccctggcactgaagcagctcccgaaaccccgcacgtccctccgtggcttcctgtacgagttctgtgtggggctctcgctgggcgcgcactcagccatcgtgacggcctacggcattggcatcgagtcggcacactcctacagcttcctgacggagcccgtcctgcacggggacctcatggccttcatccagcccaaggtgggcctcccgcagcccgcggtgcaccgctgcgccgcccagctggcctccgccctggagtacatccacgcccgcggcctggtgtaccgggacctgaagccggagaacgtcctggtgtgcgacccggcctgccggcgcttcaagctgaccgacttcggccacacgaggcctcgcgggacgctgctgcgcctggccgggccgcccatcccctacacggcccccgagctctgcgcgcccccgccgctccccgagggcctgcccattcagcccgccctggacgcctgggcgctgggcgtcctgctcttctgcctcctcacgggctacttcccctgggaccggcccctggccgaggccgaccccttctacgaggacttcctcatctggcaggcgtcgggccagccccgggaccgccctcagccctggttcggcctggccgccgcggccgacgcgcttctgcgggggctgctggaccctcacccccgaaggaggagcgctgtgatcgccatcagggagcacctggggcgcccctggaggcagcgggagggcgaggcggaggcagtgggagcggtggaagaggaggctgggcagtga

SEQ ID NO: 7152 - DNA, 3861 bp, Homo sapiens
atcgagggcatctgaccctgggtgcacgagtgaattaactgagttaatgttgactaagttcctggttagtattcacggagcaattggtgaccccaccaaaacgtcgttcaaggtgcaaggtccagaggcctcgaggagtgggatttacacatcggagccgtccgctcagacgccgttagtggagggttccgccgacttcacgggagtgaggaaagtcacttttggaaatcgactttgccttcgcccgcgaagcccgccagcgtccggactcgagttgcccccggagccactgccggaagtttaccagctcactttcggcgtcgcgcccgcctccgtggagcaggccggaagtggctttccggcagccgccgccgcagctccgtaaagcaagatggcactactcactctgaggctattatctccgttttatatctagtattcctcttctcaccagttactctcgatttccgtcccgcgccctaattttcttcagcaccacattctcatgtttttctttcattcagccttggtggagtatggtctggaggcaacctacggctagcctgagcaacgtggggcaccattttgtacggaaactgaaggcagggcgggggagtgtgaggcctcccgaggaggcccggcttgagagagagcgtgggagggagagcgttgttcaccgatgatgtatttccgcttctggtctgcctggtcgtttttggttggatcggcttgttgcggggagggagggggggagattgtttgcagcatagaagctccgcggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaaca

SEQ ID NO: 7153 - DNA, 1288 bp, Homo sapiens
gtatgtatcaggtccctgatagacaagaaagcttttggcaatctccgtatcttctttcctttcctgagtgtctcacctcatttccctgggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcgg

SEQ ID NO: 7154 - DNA, 2286 bp, Homo sapiens
atgcgtccgcaggaccccgcgctctacccgcaggccccgcaccccctagctctgggccgcgcctcacatccctcccagagccgcaacaccccacccggacgccctcgagcagccgctcgttgcgggcctcgcagagcgcctattggccagagcggccgagggcgggaaaagtggccaacggctgcctcggccctcgggctgctgaggagatggcgtcggtccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagatttggttgatgagattttggaggaactggaacacagtgtgcctcttttggaagtgtatcctgttgagggacaagatactgatatacatgttattgctttggccttggaagttgtcaggtttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatc

SEQ ID NO: 7155 - DNA, 2317 bp, Homo sapiens
agcgccccccagcaccctgaatgcgtccgcaggaccccgcgctctacccgcaggccccgcaccccctagctctgggccgcgcctcacatccctcccagagccgcaacaccccacccggcgggacgccctcgagcagccgctcgttgcgggcctgaagcgcagagcgcctattggccagagcggccgagggcgggaaaagtggccaacggctgcctcggccctcgggctgctgaggagatggcgtcgggctccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagatttggttgatgagattttggaggaactggaacacagtgtgcctcttttggaagtgtatcctgttgagggacaagatactgatatacatgttattgctttggccttggaagttgtcaggtttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatca

SEQ ID NO: 7156 - DNA, 1722 bp, Homo sapiens
atggggtttctccagttggtcaggctggactcgaactcccgacctcaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagatttggttgatgagattttggaggaactggaacacagtgtgcctcttttggaagtgtatcctgttgagggacaagatactgatatacatgttattgctttggccttggaagttgtcaggtttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatc

SEQ ID NO: 7157 - DNA, 6035 bp, Homo sapiens
atgccggccctcctgctcctcgtactcctggcctctagcgccggccaggccagggcgcgcccgtccaacgccacgagcgccgagcccgcgggcccgctgcccgccctgctggcgcacctgcggcgcctgaccggggcgctgacgggcggcgggggcgcggcgagcccaggcgccaacggcaccaggaccggccccgcgggcggggcgggcgcggcggcccgggcgccccctcccgccgagctctgccacggctactacgatgtcatgggccagtacgacgccaccttcaactgcagcaccggctcctaccgcttctgctgtggcacctgccactaccgcttctgctgtgagcaccgtcacatgcgcctggcgcaggcctcctgctccaactacgacacgccgcgctgggccaccacgccgccgccgctagctgggggcgccgggggcgctgggggtgcgggcggggggccagggcccggccaggccgggtggttggaagggggccggactgggggtgccgggggccgcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccagagctctggtggacattctgagacatcaggcggggcctgggacccgcccggaccgggcccgaagcagctccctgaccccggggatcggcggtcccgacagcatgccccccaggacgcccaagaacctctacaacaccgtgaagacccccaacctcgactggcgagccttgccgccgcccagcccctccttgcactactccacgctgtcctgctctcggtccttccacaacctctcgcatctgcccccgtcctacgaggctgccgtgaaatccgagctgaaccgctactcttccctcaagaggctggccgagaaggatctggacgaggcctacctgaagcgccggcccctggaattgccccgcggcacgctgcccctgcacgcgctgcggcggccgggcacggggggcggctatcgcatggaggcctggggcggcccagaggagctgggcctggcgcccgcgcccaacccccggcgggtcatgtcccaggagcacctgctgggcgatggtggccgttcgcgctacgagttcacgctgccgcgcgcgcgcctggtgtcgcaggagcacctgctgctgtcctcgcccgaggccctgcgccagagtcgcgagcacctgctgtcgcccccgcgcagccccgcgctgccccccgaccccaccgcccgggccagcctggccgcctcgcactccaacctgctgctggggcccggggggcccccaacaccgctgcgcgggctgccgccaccgtccagcctgcacgcccaccaccaccacgccctgcacggctcgccgcagccggcctggatgtccgacgccggcgggggcgggggcacactggcccgcaggccgcccttccagcgccagggcacgctggagcagctgcagttcatcccgggccaccacctgccccagcacctgcgcacggccagcaagaacgaggtgactgtctgaggccagggccgggtctggggggctgcggcctcccgggccccccgtcccagcctggatcccccgacacaggcgcacacatgccaggggcctggggcccagatcggcccttggacaggagtgaaagcctccttctgggatgtcctggcagacaagattcctcctcctattacttcactgcttgagccaaggcctccttcccatgatgtcatcccagaggaagaggccggctcatgaggtcatcactagcaaaaatgtctgtgttctgtgatgtcatcacagggacaaagcctcgttcccatgaggtcatcacagaggaagaggccggcccgtgaggtcagcgctggaggccatgtccatgttctatggtgtcctcagaggcttccttcttgtggtataataacagagacgacgccttgttccatgacattccttcctgtggtgtcactgcagagacaatctcacctggatgatgtcatctctaactccaaggcctcttttggcatcatcgccatggggaagatattttctccctgtgtctttgcagcagagaagatgcctctgtcctatgatgtcatcattacagacaaagccatcttcctgggacacgtcgcaggggaaaatgcctcaccgattgtgtcctcactagacataaggtccccttttcacaacatcatcacagggaccctgcctccttcctgtgatgccatcaccagagaaggtgccttgccctatgacgtcatcagagggaccgtgcctcttcctgtgatgtcatcaccagagatgaccacccactctgggacctctccaggaggaggtcccttctgtgatgtcgcccagatgctatgtgctctgagatggcacaaagagatgcctccactgctgccaccatgttgtagaaggcagggcaggcccagagtccaggaccaccccagggaagatgccagagagcagagaggggccctgtcctgagatgttgtctgaaggaagcatcgctggggagccgcccatgtggagggcctcctccagagatgatggtctgtgtaggctgttggcagtgacacccctacccccaatgctgtgatggcatcaccagagcttcctcctcagaggcactgcccactctggaaggccatcggtattggtggtgtcaccagagttactgccttgtcccaccatgacttagcttggttgctccctccccagactccagggacatgtccagcaggatctctgccagaccctctgaggggaaatggggccttggatcccacatctgtgccatgactcctgggagacaggacctccagatggccttctgctcccaggaggccactctggatcaccaggatcctggagttctggcactcataggtgtcccatagcctggcctcacttttctttctgccatatctagagacaatcacctctgtcaacaaagtcctagccttctactggggggaggtgcttggggtacacctactcttgccctcactgacactgtcagcatcacacaacacccgccactcatgatggcaccacacccggggtcaagtgttacccatgtctgaggatggaatccttccccaggattacctatgacccacaactatggtatcatcttcttccaggatttaccatgactaatggtgtcaccatctgccaagactccccatagccaatggtgtcaccatcctccatgattcctcacaaccatggtgtcatcatctttcaggagccaccacagctgacggtgtcatcatctcctagattccaccatgaccagtgatgacattaccttccagaatccactacacctgacagagacatcctctactgaaatccactaggactgatgattccaccatttcccataatccctcatgattttggtgtcatcacctcccaagacccatgatgcccaatagtgtcatcatcatttgcagggatgcatggtgtcatcatctccagggatccacttcaaccatgtgccaccacctcccaggatttcattcaaacatgtgccactacctcccagtatccacttcaactatggtgttatcacctgccaggatccacgagagccaatgctgtcaccatccactaggatccaccataaccctggtgtcatcatctcctgtgatccatgaggtccagtgctgtcaccatccactaggatccaccatgaccctggtgtcatcatctcctgtgatccatgaggtccagtgctgtcaccatccactaggatccaccataaccctggtgtcatcatctcccaggatccatgaggtccagtgctgtctgtcaccatccactagtatccaccataaccctggtgtcatcttctcccaggatccatgaggtccagtgctgtcaccatccactaggatccgccataaccctggtgtcatcatccgtgatccatgaggtccagtgctgtcaccatccactaggatccaccataaccctggtgtcatcatctcccaggatccatgaggtccagtgttgtcaccatctactaggatccaccatgaccctggtgttatcatctcccaggatccatgaggtccagtgttgtcaccatctattaggatccaccatgaccctggtgttatcatctcccaggatccatgaggtccagtgctgtcaccacccactaggatccaccataaccctggtgtcatcccagagtccactgcaaccatgtgccatcatcccccaagagccatcatcttaggagccaagtaccgtgacgggctgtatttcagttgtcctctggggccgcatggtacttacagttgttcacttaaggggaaccagcacaacaggccatattcccgtttccactaaaaggacaggggtggggccagctgtccccctctgaagacttcacccctactctggccctccttatgtcactgcctcactcctgaccgaggatgatgcctgcatcaatcccaccacagatgtggcctcagccaacctcaccttaccccccggtgaggcacccaggcccctcctgacagcagcgctgtccctcacccagccatctgattggtgacagggtcaacccagcaacctctcattatcaccagagaggaagcatttcaaccctcaggtgacgccactgccccctgcccaatccctgtcacttgggcccctaccaggatcagcactccactggccccggccaaattctcctcagagatccctgacccccgcgggataggtcaaagctggtgaccgactggggccttcagtgctgtcttctgctggcctcatcctgcagcagggacactggagagcaatggtccctgccagcacatctgcgggaccaggggtgctccttcacctccctccctaacaccttaacacccggggagcctccgggggtggcaggaagtccccagcacccaatgcacaatcttccctcaattctctttgtacatagccatgttgcgggggcggccattcccccactcttaaagggctacacgcccctcccccagcccctagggcgaggtggggggggcctcttcttcctcccctgggccgtccccctccctcttatgtctccccgcaaacactggcacctcacactccttcttgtcaggagcttggggcagacaactggcccttggttcccaccacactgaggaaatgggggttacccaaatccacctgggccctggtgccagtttttcaaccccacggcttctagctgctctgaggggctcctcccatcccttccagggcctccccagccccgcactgctcaggccaactgtgacttccccagaaaggagccagcttgagcacccaccccctcccagccccctcccctctgctcaacacctccgcggaacactcagctttctccagctgccgggatttgggggtctgggcctttcagcttttttatcccccctccactagctctagcccagcctggattccagggatcccacccctagccctgtccctattcagttggcacaggctgcctgaccctggggccttgatttgatctcaaataagccatagaggagagaggtcttgaggggtgggagcaggtgtgtactgacaattcccctccacatgtcttgagctgggacctcgtcatctgagacttccccatgccccaacaaatgcaaatgcacacaaacccatgcatacacaagcacacacacacaggcatctccccgtctggttgggggagcatgggagggggcacttcacagggagaagataaatagttccacacctgaagaccctccaacagcttctgcctccctcctcatcacttcctctctccaccccctctccaacactggccccttcccctaattaattccctggtgaggacagccagaggagctgcgacttggtattttttggaataaatagacattttcctgatc

SEQ ID NO: 7158 - DNA, 1504 bp, Homo sapiens
agtcgctatgcgtgtgcttgtgggtgagggagggcagaaagggagagtgctgggcgggcttagtcggagattgaggactgggaatccgcttccgggagggcactgtctagtgcacaggcaacctggccttggcctcctagcccgagaagccgaatctccctaatccctgtgacctgtgtcacctctgcatcgcgaggagggggataagtggggagaagcctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggcacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcact

SEQ ID NO: 7159 - DNA, 912 bp, Homo sapiens
atggctctgtctccaaatggggagatcctaagggccagagaagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcact

SEQ ID NO: 7160 - DNA, 1233 bp, Homo sapiens
aaactttacgcaggcgcgttaggtcctagtcgctatgcgtgtgcttgtgggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcactaa

SEQ ID NO: 7161 - DNA, 465 bp, Homo sapiens
ttccacgtggcttcctatggaatgtccggggctgagaagctgcagaaagagcagattgagtctataaatgttggaggcaccaaactagtgattgatgtctgtgttcgccggcgggttccaaggctcatctataccagcactgtcaatgttgcatttggagggaagcccatagagcagggcgatgaggactctgtgccatatttcccattggacgagcacgtagaccactactcccgaaccaaagccatcgccgaccaattgaccctcatggccaatgggatgcctctcccaggaggaggcactcttcggacgtgtgtgctccggcctccagggatctacggccctgaagagcagaggcacctgccccgtgtggcgggccacatcaagaagaggctgttcatgttccgatttggggaccacaaggcacggatgaactgggtccacgtacacaatctggtgcaggca

SEQ ID NO: 7162 - DNA, 9556 bp, Homo sapiens
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttgaaaataataaataaaagccactaacaatccaagaagttattaggcagaatcccaggcccaccccaaacccagtgatagcagtctgaattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 7163 - DNA, 1930 bp, Homo sapiens
actgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggatggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcgtgaacaatttgttctcggtctctgccccagccctgactcagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcgagccctggacctctctgtgcagtatcctccagagaacctgagagtgatggtttcccaagcaaacaggacagtcctggaaaacctgaggaacggcacatccctccgggtcctggagggccaaagcctgcgtctggtctgtgtcacacacagcagccccccagccaggctgagctggacccggtggggacagaccgtgggcccctcccagccctcagaccctggggtcctggagctgcctcgggttcaaatggagcacgaaggagagttcacctgccacgctcggcacccgctgggctcccagcgcgtctctctcagcttctccgtgcactgcaaatcagggcccatgacgggggtggttctggtggctgttggggaggtggctatgaagatcctgcttctctgcctctgcctcatcctcctcagagtgaggtcttgcaggaggaaggcagcaagggcagcattgggcatggaggctgcagacgctgtcacggactaatctccagactccagactgcttccagatgcctcctcatccagttcctccacagtctgagcggccgtgtttcctctgcaggctttgcatggtctgtcccctgctggactctcctgatccctcctttccctgtcacccaacatctccccaaaccctccgggccaaggactctgcggctcttgacactttgcacgtgtagtttcttctcctgaaacacccttccctccagcctgggcgacagagcaagactgtctcaaaaactaaaacaaaaaaacaccaccaccaccaccaatgtctgattaaatctaagccacggttccattttggggcaaggggc

SEQ ID NO: 7164 - DNA, 1882 bp, Homo sapiens
actgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggatggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcgtgaacaatttgttctcggtctctgccccagccctgactcagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcgagccctggacctctctgtgcagtatcctccagagaacctgagagtgatggtttcccaagcaaacaggacagtcctggaaaacctgaggaacggcacatccctccgggtcctggagggccaaagcctgcgtctggtctgtgtcacacacagcagccccccagccaggctgagctggacccggtggggacagaccgtgggcccctcccagccctcagaccctggggtcctggagctgcctcgggttcaaatggagcacgaaggagagttcacctgccacgctcggcacccgctgggctcccagcgcgtctctctcagcttctccgtgcactgcaaatcagggcccatgacgggggtggttctggtggctgttggggaggtggctatgaagatcctgcttctctgcctctgcctcatcctcctcagagtgaggtcttgcaggaggaaggcagcaagggcagcattgggcatggaggctgcagacgctgtcacggactaatctccagactccagactgcttccagatgcctcctcatccagttcctccacagtctgagcggccgtgtttcctctgcaggctttgcatggtctgtcccctgctggactctcctgatccctcctttccctgtcacccaacatctccccaaaccctccgggccaaggactctgcggctcttgacactttgcacgtgtagtttcttctcctgaaacacccttccctccagcctgggcgacagagcaagactgtctcaaaaactaaaacaaaaaaacaccaccaccaccaccaatgtctgattaaatctaagccacggttccattttggggcaaggggc

SEQ ID NO: 7165 - DNA, 1004 bp, Homo sapiens
tgcgcggcgcatgcgtggcccggggtctcggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgccttcgggtaaaaagcgcccgcaggcccgtatgctgctcctggcgctcttctgcgtggccgtcagcgtggtgtggggcgtcttccgcaacgaggaccagtaa

SEQ ID NO: 7166 - DNA, 3811 bp, Homo sapiens
tgcgcggcgcatgcgtggcccggggtctcggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcggtgaataccagtttgctctgactgtgagaaatactcgcctagtgagccctaactagagttaaaaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccagtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgatacatatggcccggcctctgcctccgcagtgcacggcttggggcatctgctctgtgcaggtcccggtgagcagaactgagagctggcaggccgcctggctgtcctgcagaggacggattggaattgccaccgcagggccggccagtgctgtgaggtgcccagcgtcactcccatgggctctgtgggccatgtggtccctgtcacgcttctcagctctgccactgttgctggaaagcatcacagaccatgtgtaaaatgggccaaaataccttttacaaaattaaaatagagatggggtcttgc

SEQ ID NO: 7167 - DNA, 1671 bp, Homo sapiens
gccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 7168 - DNA, 643 bp, Homo sapiens
tcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 7169 - DNA, 745 bp, Homo sapiens
ccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 7170 - DNA, 7994 bp, Homo sapiens
ggactcgcgcgaagcggcttggaagtgggcagcctggaagtcactcgggccaccggagctggcggcgtctccagcgagcggcgcggagctggacgccgcgatcgtggggcccgcgaggcgggcagccggggcgtccagatgcacagtctctgacatcagctctcctgggaccctccaagagcactagtgtctagaaggcactaaggcatggcgaggacaacatccttgctgcctccagctggcgggcgaccacagctactgcctgctctgcgctactgagccactcggtctggagcccccaggacagcacctgcttcctgaggttgtcctggctcagctgtgcacagcgatggtggagaactggactccacaggctcacaaccttcctgtcaggtttcagggcccagcatccttcatcctgggcctggctgccctgaacaatggctgagggctgggggaccccatagagtgacaccacagcgtacggggccagcagcactccagtgcccgtggactatgaccacctatcgggccatccccagcgatggtgtggacctggcagccagctgtggcgccagggtgggcgatgtcctccctgggccacacacaggggactacgctcccttgggattctgggcccagaatggcagcatgtcccagcctcttggcgagagcccggccaccgccaccgccaccgccaccgccaccacccgccccagccccaccactcccgcaatgcccaagatgggcgtgcgcgcaagggtggccgactggccgcccaagcgggaggccctgagagagcacagcaacccaagcccctcccaggacacagatggcacaaaggccaccaagatggcccattccatgaggagcatacagaacggacagccccccaccagcaccccggcttcctcagggtccaaagccttccaccgactctccaggagaaggtccaaagacgtggagttccaggacgggtggccccggtcccccggcagggccttcctcccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcgcacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaaggtttcatagaaatgg

SEQ ID NO: 7171 - DNA, 687 bp, Homo sapiens
ctgtttcctttttcctctggcgagctttgcgttccctgtgcgccggaagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 7172 - DNA, 636 bp, Homo sapiens
gtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtag

SEQ ID NO: 7173 - DNA, 630 bp, Homo sapiens
gggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataa

SEQ ID NO: 7174 - DNA, 989 bp, Homo sapiens
acctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 7175 - DNA, 1487 bp, Homo sapiens
agtttgtagtgtattctggagtcaagttgacctacatagaagagaaggaactggaagtgcatgtctgtgttctggctccgattgggaaaagctgcttaaccactctagccgatggcggagtctcttctcttcaactgcctcactggcttttccttatagtcctgttgcaagactcagcccttatagcaatggcattaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaaataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctcta

SEQ ID NO: 7176 - DNA, 2310 bp, Homo sapiens
gtaatttgcctggcaagtgatcagactggtataaaataacatcatctgttaggcaagatagcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 7177 - DNA, 2015 bp, Homo sapiens
ggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagc

SEQ ID NO: 7178 - DNA, 810 bp, Homo sapiens
gtgctgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttcgttcttgctgtttgaattttgcagtcgtgtgcccttttgcgttgcattttcattgaaatcttattttcagagactgacttgctttttaaaatggggtgacctcactggctttcccataaatagtgccaataaagaggacttttcttggagtggaatgaacaggttatacattggctcttcaaagacgttcacctcatcagagaaatccctgactcctttgcagtggtgtagacatgtcctagataacccaactcctgagatggaagcagcgagacgttccctgtgctttagactggagcaaggtaattgtgagtgtgtgcatttacattctccaactcttacaaattgctgactgtttatatatgaattgtgaagcatgtatagatatcagtcctgcagatggaagaacacacttttcctttgtgtttcaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatag

SEQ ID NO: 7179 - DNA, 2729 bp, Homo sapiens
atgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgctgccgccgccgccgcccgccgcgccgccccccgctggcctgcagcctttgggtcctcggagccccccggccgccacggccaccgccgcggcctcagggggcctgggccccgcgttcccgggcaccttctgcctgcctagccccgcgccctccctgctttgcagcctggcgcagccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 7180 - DNA, 2374 bp, Homo sapiens
agccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 7181 - DNA, 1033 bp, Homo sapiens
agcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaat

SEQ ID NO: 7182 - DNA, 2637 bp, Homo sapiens
cggccgcggcgccctcggggcccacgatgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgctgccgccgccgccgcccgccgcgccgccccccgctggcctgcagcctttgggtcctcggagccccccggccgccacggccaccgccgcggcctcagggggcctgggccccgcgttcccgggcaccttctgcctgcctagccccgcgccctccctgctttgcagcctggcgcagccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaa

SEQ ID NO: 7183 - DNA, 570 bp, Homo sapiens
aattttcattattatacaggcatgttggctttaatcaaagttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgc

SEQ ID NO: 7184 - DNA, 531 bp, Homo sapiens
gcttttccttatagtcctgttgcaagactcagcccttatagcaatggcattaatactcccagcttctctaaaacctcaaataaagcaatactaacacctgaaaaaacaggtaatattttaacttcttgactagctgcttgctttgtaattcagttactaaacacggcttaaatattcatctttcatttgaaaagcttgagaataatcttaagagtggagagtttgtgctgcacacttactttgggtacaaaaggcctagcactaatttgtactctaacaccattgatctactgctctcaattttatgtagcagacagtcttccctctttagcaaaagtatatgcatgcagttctgtatttccaaatgcttatgtgcttttaaaattaaatgtcaaacacaattaaggttacacttccaggggctccccactcagtccccagtcatctatcgacagtgagctgagtacttcagaattggaggatgattctatctccatgggatataaattacaggacctcactgatgttcag

SEQ ID NO: 7185 - DNA, 1461 bp, Homo sapiens
agtgctgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaat

SEQ ID NO: 7186 - DNA, 576 bp, Homo sapiens
attgcgaatgtggtttccttgcctagttcttccacatacttaaggaaaagatatttttaatgtaattgttagaatgtgttggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggaggta

SEQ ID NO: 7187 - DNA, 4154 bp, Homo sapiens
gttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 7188 - DNA, 3995 bp, Homo sapiens
gttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 7189 - DNA, 4142 bp, Homo sapiens
gttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 7190 - DNA, 1889 bp, Homo sapiens
ccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 7191 - DNA, 703 bp, Homo sapiens
gcgcagtgacgcgccggccatgccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatca

SEQ ID NO: 7192 - DNA, 5469 bp, Homo sapiens
gccccaggggcggtgctggccagaccctgccgcctgagagagagcacagcctggtgggttctggggtctacggcctaggggccggggaagtttgcgccgccgcgaccagtgctgcgatcccgagccgggctccagccccgaggaccaggggtcgggcgggcctgcctacggaaccccgcgggccagcagcagtcgtctcgcgtcctcctgcttggaaaagtgtttaagcttctaaaatgtcatctatcaagcacctggtttatgcagttattcgtttcttacgggaacaaagtcagatggacacttacacctcggatgaacaagaaagtttggaagttgcaattcagtgcttggagacagtttttaagatcagcccagaagatacacacctagcagtttcacagcctttgacagaaatgtttaccagttccttctgtaagaatgacgttctgcccctttcaaactcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaacaaactcaaaacataacatgactccttttgaaatgatcactagccatgttacgtgccaatatagcactgggataaggttccattttcaaacttctatcatatttgtatattagacttaatagcaaagcatatttattgaactctagtagggctatttgttggtaagctctttagctccaatttcccttaagcaaagttttttgagaagggaaatgacccaaaggaaaggtttcctatgctggttgagaagaagtgtacttgccactgagcagtatgtcaggaaagaaggaatattatctaggtttagctttgataagtgctattagtaatgaatatataacatgggaaccaatgttatctttaatgttgcttgttctggtgaacagagaatcttaagagctgttagaaagtagcacttgatgcaagggatgttttgaaaagaaaaaattggtaatgcgaatgtatagaaagtaaaggtaggatgctcaggttttctgcatagttcttaactaatcttgtctgcagtttggtattgataatattagcatggccacttatgctaaatacacaataagatacatttagaaatccttaatgtactggttaggtcagtggtacaactgtttgacttaattatcacaatttccccaatggtaaccttaccttggaaactatcaaatataaatatactttaactaagccagtgacctggtcctaagttaaggattttctaaatggtatttaattgtgtgcccataaacactgattttttttaaaaagaaaacttagtaattatttgatggataacaaaaagcatctatcactaacattgcttgttcatgtaatcttctgtgataatttggcttggcatgccagtcttataattaacataatttaaatttgatgcaatttaaatataacaggagacttaaaatattttattataaattagatgccatattagttagtggagaaaaggggcattaggtattaattgcatgggtctaactacattgatgatgagagtttaattccaactagagtatattttttgtttattaataatgaaattggtgctgacatgtaatgacttcacaagttttacgagggaaaactgaaaaaggaagtaatataaattttgtggggtttttttgagatggagtcttactcttttgccaggctagagtggtgttgcaatgtcagctcactgcaacctccacctcctggattcaagtgattctcgagccttaagctcccaagtagctgggattacgggcgcccaccaccacgcccagctaattttttttttttttttcttgagatggagtctctctctgtcgccaggctggagtgcagtggcgcaatcgcggctcactgcaacctctgcctcccgggttcaagtgattctcctgcctcagcctcctgagtagctgggattacaggcacgtgtcaccatgcccagctaatttttgtatttttagtagagacggggtttcaccatgtttgccaggattgtctcaatctcttgacctcgtgatccgcctgccttggcctcccaaatgctgggattacaggcgtgagccaccgtgcctggccgctaatttttgtttttaatggagagagttccaccgtatcggccaggctggtctcgaactcctgacctcaagtgatctgcccatcttggcccctcaaagtgctgggattagaggtgtgagccactgtgcctggccaggaagtaatatacaattaaatgagtaataatgcagatgattaggccttatagaacccttatcaaaagactaattggccgggcgctgtggctcatgcctgtaatcccagcactttgggaggccaaggcaggggggatcacctgaggtcaggagtttgagaccagcctggccaacatggtgaaacccacctctactgaaaatacaaaaattagcctggcttggtggcgggcacccgtagtcccagctacttgggaggctgaagcatgagaattgctcgaacctgagaggcagaggttgcagtgagccaagattgcgccactgcactccagcctgggtgacagagcaagactccatttcaaaaaaaaaaaaaaaaagaaaaagagactaagagactaattattttgtatcttgaagtttaaaatccaacttttctctttctcctttgtgacattagaacagtagttctataacttcattgtaagaatcacctggataattcattaaagatgcagattcagggccacgtgttcaattctgatacagtaggtcctgtaataaggcctaggaatggccatttttaaacagtacactaggtggttttgatacagatccaaggactctaatttagaggaacactaggttagaggtttctcagacctgcaaacacctaagcacctgggccaaacaaagctacaacgaagatctgtatgaagatatatagttctgcagaatttaaaaagagcacaatttaagtcttcggccctcagaagttaaattcatattccatctaagccaactttgattttcattaagttagaatgaactcctagtattccagtattacacagaacgaagtactactactaacacatagaagtcattactgtgatataaaaagcaaaatagatccttaattaaaaattagtcactcatattcagtgttgaataagaagttaaagtttctagcataactatcttgagtgcattaaaaatgcttttagagcaataagataagcttctagctgactgcctagaaaaacagaagatacaaattcagtgtcagaaatgaaagggaatacactacagacactatagttattaaaaggctaactagaaaacaccatgaccaactcaaggattgtatatttaacaacttagatgaaacagattccctataggatacaaactagaaagctcactgtagaaacagataacctaaacagaaccatatttattaaggaaattgagtttgtggttaagttaaaaaccttccagtaaagaaaactacaggcccagataacttccgtgatgaattttaccaaacacttaagggagaaataatatcaattctaaacaatctcttccaggaaacagaagaggaggaaatacttcccaactcattttatttgaccagtattacccagacaaagatactataagaaaaaaaactttaaaacaatgtcttcatgtgctaacatctgtagttaaattagccattctttttacatgaaataatgggaattggtatatttcttccatttcatttttctatttctttgctaatataccacctgtaacaaattcaatctagatgctatctgtccacttgcctacatttccattctattcaagccatttttgctcttcaagtaccttgatcactttggaatcatagcattgcaagctatttcaaaaaaagttgcgtggttggattgtgctagctacttttaaatttataaaaaatgccccatatattttcttgcttgtctgggaaatatagttgctatctaactagaaaaataagagggcattattaaagtaactctttaagcatcgtactaaatgtttgacttccattaaccatatttcttgtagtagctgtagctattatgatactgtgtaaaacagaacaggttctatatatgcaaatgacattttcatttaatgtaccaaattgtgtatctaacttttataatataggttaaacagatcctttctaagatggcattatttaatctttacttaaaactatgaaaaatatgtgtaagttattgtttataaacagaagagactataattaaaatatagagcagattccaagtgaccatcattttactttttagatttaaaacagaatgaaacagaagatttagtcataagaagatgcttgaaaaacaatccaagtatccaatgcagtggctataaaatattatttcatcatttaatcttaatcattttgaaacaaagacagacttcaattttacactgcttgcactttattttgtacagacatttcattaattattactcaattttgaggtgcaaaccttctgaatatagctttcattttggaccaaacaatttgttatggcaataaataatgatgcattgaaaaaccaa

SEQ ID NO: 7193 - DNA, 887 bp, Homo sapiens
aagcaatccaaaacagcagctcaggctgcccaaagccgtgtccaagcgatcattttctccattttgggccaagtcaatttgcaccggcaagaggcagaatgtttgttttatggggaggaggaaaataaaaaaggaagtcagagagcatggacggaaacaagcaacaccaccaaagaggtttcatctcgggtggatgttaaacgattggaatgctaataatgggcgcgaggagcaaacacaattgttctgagtccacagctgcggcacttttaatgacaggaaaagtgtttaagcttctaaaatgtcatctatcaagcacctggtttatgcagttattcgtttcttacgggaacaaagtcagatggacacttacacctcggatgaacaagaaagtttggaagttgcaattcagtgcttggagacagtttttaagatcagcccagaagatacacacctagcagtttcacagcctttgacagaaatgtttaccagttccttctgtaagaatgacgttctgcccctttcaaactcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatag

SEQ ID NO: 7194 - DNA, 546 bp, Homo sapiens
ggtgaggcgcgcggggtccgggctgcggcttcccggtgcggccgcagtgggcaggctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccaccgagaaggccccgcccctcccgctgcagccccacagcatgcagccccaggagagccacgtccactatagtaggtgggaggacggcagcagggacggagtcagcctaggggctgtgtccagcacagaagaggcctcacgctgccgcaggatctcccagaggctgtgcacgggcaagctgggcatcgccatgaaggtgctgggcggcgtggccctcttctggatcatcttcatcctgggctacctcacaggctactatgtgcacaagtgcaaataaatgctgccccgcatgcacgcggggggctggccgcacacgtgagagcacaggcctggagaca

SEQ ID NO: 7195 - DNA, 957 bp, Homo sapiens
ctgacttctctcaggagggactcatgaacacgtgccctgagcacccccaaaatgacatcacacaagggcagaaaggagctgaagggggaacgtgaaaggcagaaagggagccgtggttgccaggcaaccagccctagcccacctttgtttgtttggtgacagcaactaaggtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccatcaggaaaaagtctagtaaaatactgtatctggcttagggttggtcagactagtaagatggggaggctggtctgagaccaattctggctccttgaccctattgtttttagggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctgctaa

SEQ ID NO: 7196 - DNA, 469 bp, Homo sapiens
agcttgcaagtgtgctctttgtgaaattccaccatggcatacagtggccagggccagaaagtgcagaaggttatggtgcagcccatcaacctcatcttcagatacttacaaaatagatcgcagattcaggtgtggctctatgagcaagtgaatatgcagatagaaggctgtatcattggttttgatgagtatatgaaccttgtattagatgatgcagaagagattcattcgaaaacaaagtcaagaaaacaactgggtcggatcatgctaaaaggagataatattactctgctacaaagtgtctccaactagaaatgatcaatgaagtgagaaattgttgagaaggatacagtttgtttttagacgtcctttgtccaatatgaacatttattcatattgttttgattacacttatgtttttacaagatggcaataaatgctgtgggattgtttgtattaaaactaataa

SEQ ID NO: 7197 - DNA, 734 bp, Homo sapiens
gagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggattt

SEQ ID NO: 7198 - DNA, 2844 bp, Homo sapiens
aattcactcagggcctaagagctttgggcagttaaatccccctccccgacaacagactaacaggtcccattttgatatcaagggctggggtttcaagacagggaactgtggggcccacgctgtcctggcctccctggaggcctggctgctctcatgccaggaagggagcttccatttactacgggcctaggatggccgccccgctgcccccagcgctccctgggtgggtgcggatcctggccagtcccccagacacgcagtctgctgaccagaagcagcgaccttcggggagagccagccaccagccagccactgctccagaggcaggcctggggccacccgggaggctttcctcaccacggaaaatatttgcctttggttgtcggctgatgccttgtcttgtgtctgaatggacaactggctgatttctctctctttggaacagccatgaaatgcgaaggtgtttaagagtaaaaaccaggcgagggcaactgggcctggcgtccagctgttttgaacaacactcttgtttttctcccagagtgaacagaatactttctgcggttcagaatactctgtgcactggcccctcttcccaggccccgccccagccccctcaggcctcacctccagctgctgcagaccattccagaactccctccctcttggcttctagtcactcagcatctgggggagagagcctcttccagctgtacatagctagcttggcctggccccagaactgctgtgttctggaaagttgtaggagaatccctcttggcgggctctccagcatggagaatcgcaggcctctgctccggaaagggaggcttttgagaggtcagattcaccacagccagaccaatgaactgtgagggctcataggggctggggctccggtttcaggggtgagaggagccaccatctgcccccatgcccactctgattgtaaatggctagactctggtgccggggtcagctctggattcatatcccagctcctgcatatgtatatgctgggtgaccttgggcagtttacttaacctctctgtgctttgtgtgcctaagctgcaagatactctaaattaaacagcaaactttcagtgctgttgtgggacgaaatgggataatgtgcttggtagctggcaggggctcaataaaaggtagcaacttccagggccaccagttcatggggagccaggtccaagtcttgtactttctatgcctcccagggagccacgtatgtctgcgacagagctggggaggacattctggggctgagggttgaggtctgcccatagagcagcggcctgtacctgcaggcaggtagagtatcatcctggctgagtctcagtgctcctcaaacattaaagtgtacatcctggtgagacgcagattttgatgcagcgggtcaggtgggacaggggttctgcagctgtaaggaactcccaggtcaagccagtgtggcaggtctgtgaccgcagctggtacggcaagatctcagccctggaagactctgggttctgctgaggctgggctcagagagagaatacaagttttgtcctgtccaaggagcaccctccaggatttcaggacaaggctctggctctgtgtccccaagccctcagtctcagagcttgggtcctgcagtggcctgggcaaccctccggactctccattcagcatttgttcctgacagcagtgcacggataaagagcagtttcatgctgctgaacttgcaatcacttcaaggcctgggcccctctgggcctcagtttccccactggcacagtgggaagctgggataagctaatcccaccctttccccttggtaattccccacattgctcttcccttcccttcatcccttcccaaaacacaggtctgaggcctgagcatccatcctaggggctgggcccccatccccatgactgcagtcatggggtacaagactcatgcagactcgtaagaacagccacttctgacctggggcctcgatgttccaggcactgtcctaggcatttgcatctacaaacttctcaccataatccaatcaccactgttttacagatgaggaaactgagccccacggggtgaagcctattgcctgagatcttgcagttggtaacgggtgcaggctggactcaggcccccacacatgcccaggcccttgagtatttgtaagggaagcagctgtttggttttcttggcacagagcatctgcctagctggtgagggcatggggaaagaggtgcccaatctagttggggatgggagggtaaaatggtactacctctttggagagctttctggcaatatggacccaaatgcaaattacatgtgccctctaacctgggcccgaagtcatctgcacaaggctaccaactgcaatgtcctttgcagcagcaaaacacgggatcccctagctgtccatccaagggggatgagggagatacatctgggaggttctattggctgagtactcagagaatggaagcaccacatggattaattggagcagtcttcaagttggtgaaaaaaagtgcagtgtagaaagtgtgtacagggccgggtgcagtggctcacactgtaatgccagcactttgggaggctaaggcaggaggattgcttgagcataggagtttgagaccagcctgggtaacatggggagatcctacctctacaagaaaaaaaatgaactaggcaggtgaggtggtgtttgcctgcggtcccagctacttgggaagctgaggtaggaggattgcttgagcccatgaagtcaggctgcagtgagctgtgactgcaccactgcacagtctgggcgacagagcaagaccctctctc

SEQ ID NO: 7199 - DNA, 3335 bp, Homo sapiens
cccctgcggcgtcccgtagcctcgcgttaagccttgttcagagcgggggcttttgctgtcgcagtgggttccggagagtgcaggtgatttcgcagcaggtttcttgtgctggccgcgctcgccggacgaagaagagaagggcagttgggcctgcggccttggcgttcatgaggcctcagagagctccggaggagctacaactgtgagggggctgctagagttcttctcctcgggtgtgtgagaagcagcctaggaccccgggttcggggagtcgcaaagaaggccgtaagggcttcacttccttctccggaggcctgccttctgcgcgtcgattaacaccgcattctttcccacttcctctcaatgttttcttcatatatctggaaatatgatcagcgcccctgacgtagtggccttcaccaaagaggaagagtatgaagaagagccttacaatgagccggccctgcctgaggagtactcggtgccgctcttccccttcgccagtcagggtgctaacccctggtcaaaactgtccggggccaagttttcgagggacttcattcttatttccgagttctctgagcaggtgggaccccaacccttactgaccatccccaatgacaccaaagtttttggcacttttgatctcaattacttctccctgcgtatcatgtctgtggattaccaggcttccttcgtgggccatcctcctggatctgcctaccccaagctgaacttcgtggaggactccaaggtggtgctgggagattctaaggagggcgcctttgcatacgtgcaccaccttaccctatacgacctggaggcccgtggcttcgtgaggccgttttgcatggcttatatctctgcagaccagcataaaatcatgcagcagttccaggagctttcagccgaattttccagagcttctgagtgcttgaagactggcaacaggaaggcatttgctggggaacttgaaaaaaagctgaaagacttggattacaccaggacagtgctacacacagaaacggagatccagaagaaagccaacgacaaaggcttttactcatctcaggcaattgagaaagccaatgaactggccagtgtggagaagtccatcattgaacatcaagacctgctgaagcagatccgctcataccctcatcggaagttgaaggggcatgatttgtgtcctggtgagatggagcacatccaggatcaggccagccaggcatccactacctctaaccctgatgagtctgccgacacagacctttacacctgcagaccagcctacaccccaaaacttatcaaagcaaagtccaccaagtgttttgacaagaagttgaagaccttggaggagctctgtgacactgaatatttcacccagaccctggctcagctcagccacattgaacacatgttcagaggagacctgtgttacctcctgaccagtcagattgatagagcacttctaaaacaacagcatataacaaactttctctttgaagactttgtggaggtcgatgacaggatggtggagaaacaagaaagcataccctctaagcccagtcaagacaggccgccttccagttctctagaagaatgcccaattcctaaagtgttaattagtgttggttcttacaagtccagtgtggagtctgtgttgatcaagatggagcaggaactgggagatgaggagtacaaggaagtggaagtgactgagttgagcagtttcgacccccaggaaaacttggactacctggatatggatatgaaagggagtatcagcagtggtgaaagtattgaagttttgggcacggagaaatccacctccgtgctttctaaatctgacagccaggcaagcctcacagtaccattgagcccccaggtggtccggagcaaagcagtcagccacaggaccatcagcgaggacagtattgaagtcctcagtacctgcccctctgaggccctcatccctgatgactttaaggccagctacccaagtgccattaatgaagaagaatcatatccagatggcaatgaaggagccatccgcttccaggcaagcatcagtcctccagaactgggtgagacagaggaaggcagcatagaaaacaccccatcacaaatagactcctcctgctgtattgggaaggagagcgatggtcagttggtgctgccctccactccagcccacacacactctgacgaggatggggtggtgagcagccccccacagcgccacaggcagaaggaccaggggttccgtgtagacttttcagtggaaaatgccaacccttcttcccgagacaacagttgtgaagggtttcccgcttatgagctggacccgagccacctgctggctagccgggacatcagtaagaccagcctggacaactactcagacaccaccagctacgtgagcagtgtagcgtccaccagctcagacaggatcccctctgcttatcctgctggcctgtcttccgataggcataaaaagagggctggccagaacgccttaaaattcatccgccagtacccctttgcccacccagccatctactccctgctcagtgggaggacacttgtggtcctgggggaagatgaggccatagtcaggaaactcgtgactgcactggctatctttgtccccagctatggctgctacgctaagcccgtgaaacattgggcctcctcccctttgcacattatggattttcagaagtggaagcttattggcttgcagagagtggcctcccctgccggtgccggtaccctccatgccctgagccgctacagccgctacacgagcatcctggaccttgacaacaaaaccctgcgctgccccctttacagaggcaccctggtgccccgcctggcagaccaccgcacacagatcaagcggggcagcacctactacctgcatgtccagagcatgctcacccagctctgctccaaggccttcctctacaccttctgccaccacctgcacctgcctacccacgacaaggagacagaggagctggtagccagccgccagatgagcttcctaaagctgaccctgggtctggtgaatgaggatgttagggtggtccagtacctggctgagctgctgaagctgcactacatgcaggaatctccagggaccagccaccccatgctcaggtttgactatgtccccagctttttgtataaaatctgaggtcggtcccagacactgtgaccaagacctgtgactcagggtatggggaggggaggggttggcatgaccaaacagttgcctgagctggactgtttaagtttctggtgtctggcagcatggttcccacgtggct

SEQ ID NO: 7200 - DNA, 1914 bp, Homo sapiens
gacagcgcgtagtcgcagagtcagggaggggacctcaccacctgtctcctccctgaggtcttagaacagatacaagaaattccaggcgaaggtcccacagagtttggatcacgatgaggccagtgagtcggagatgagaaagacctcaaactcctgcatcatggaaaatgggcaccagccgggggcaggtccaggcgatggaccccctgagattgcccaaaacttctcagcaccagatccccccaggcctcgtcctgtgagcctctccttgcggctgccccaccagccagtcacggccatcacccgagtctctgacaggttctctggggagacctcagctgcggctctatcacccatgtctgctgccaccctggggggcctcaacccaagccccagcgaggtcatcacgccctggactcccagtcctagcgagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaa

SEQ ID NO: 7201 - DNA, 2285 bp, Homo sapiens
cggagctgcggagctcggatcttctcccccgtctggcccgctctcgacccgcgcgctctgctgggccatggagccggcccccgacgcccaggaggcgcgcactgtgcgcgaggcgctgggccgctacgaggcggcgctggagggtgcggtgcgcgcgctgcacgaggacatgcgggggctgcagcgcggcgtggagcggcgagtggcagaggcgatgcgcctggccggccccctggcgcgcacggtggccgacctgcagcgggacaaccagcggctgcaggcgcagctcgagcgcctgacgcgccaggtggaggcgctgggcttggccagcgggatgtccccggtgcccggcactcccggcacgcccagccccccgcccgcgcccggggttcccgaccgcgcgccccgcctgggcagcgcacgcttcgccagccacgccaccttctcgctgtccggccgcggccagagtttggatcacgatgaggccagtgagtcggagatgagaaagacctcaaactcctgcatcatggaaaatgggcaccagccgggggcaggtccaggcgatggaccccctgagattgcccaaaacttctcagcaccagatccccccaggcctcgtcctgtgagcctctccttgcggctgccccaccagccagtcacggccatcacccgagtctctgacaggttctctggggagacctcagctgcggctctatcacccatgtctgctgccaccctggggggcctcaacccaagccccagcgaggtcatcacgccctggactcccagtcctagcgagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaattttg

SEQ ID NO: 7202 - DNA, 994 bp, Homo sapiens
gcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaatga

SEQ ID NO: 7203 - DNA, 1066 bp, Homo sapiens
gcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaatga

SEQ ID NO: 7204 - DNA, 2593 bp, Homo sapiens
aggtcgaggcggggttaagggtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaa

SEQ ID NO: 7205 - DNA, 343 bp, Homo sapiens
agagtggagtggctgtcagagatgcctgatgttttggcctaaggaccagtcagtgaggcaatggagcaagcaagggatcacttacacctgagatggactacagaacagcacatgcccgaggtggaagttcaagtcaaatacagaacagctgcactgagcaaccaagagtgtcaattgtacctgaggcattctcagcagcagcaagtgcttgtggtggatttccaggccaaactgagacaggtattcataactgagacaccaagatgtggtaaaaagccgtactggaacaatgaggaagctgaatccaagcaaaatccaggctccatctactgtttgcttctgc

SEQ ID NO: 7206 - DNA, 1919 bp, Homo sapiens
tccagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgacttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 7207 - DNA, 3484 bp, Homo sapiens
atgctgcctttagaacgaactatcacttacagagacatgtcttcattcatacaggtgaaaaaccatttcaatgtagtcaatgtgacatgcgtttcatacagaagtacctgcttcagagacatgagaagattcatactggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcct

SEQ ID NO: 7208 - DNA, 2831 bp, Homo sapiens
agttgccaggggagattgaaaagcagcctatgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcctaa

SEQ ID NO: 7209 - DNA, 1631 bp, Homo sapiens
ccaaaattacagtagcccagtttcactttgactagaaagtccctttgtcagctgtttcagtacattctgtgacatttagaaataatttaggtagctgtgttgggtgtgtacaattagtaagtgatggaatgagttgaagcagattcaatacagtgagctggtttcttacctccaaacttaatttgtgaccaaataattgattgctgggaggggaagaaaactaattccttcattttatttcccaaagtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaagtgagtggtgacaaacaggtttaatttcctttatcttcctatgaagtcttaccctagcacttgttttggccatttctaaagtaggtaggactaggtgattttttttcccatgagtctacagaatcttggaatttttggttttagttatggagtcattttggctgctttaactatgtctaaagcctctctgaaaaagaagctgagaacaggtacgcttctggtttttcaggcccctcttgttaatgtaatttctcctttggataactggccattctttttcaaaattgatctccagaggactttacgatgaccaaatcattgacctgtctgttttcaaacttgagccattgtctatttctgggagtcactgtgtgtcgcatctgagtctagcttaggggaggggcaggatgcttagagtgtttgagagcacagttggtccacatataatgatactgttttttatacctagatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtt

SEQ ID NO: 7210 - DNA, 3807 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttcctttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagaga

SEQ ID NO: 7211 - DNA, 697 bp, Homo sapiens
ctggcacgatggagaactgcatgaagaggcagcggagtgctgtctgtccccacccttccccgcccggcctccaactggtgggaactggattttgcggctgcagaggacttccccaaattttgccacattaacagctgactgcacatctgagccccgaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcaccta

SEQ ID NO: 7212 - DNA, 664 bp, Homo sapiens
catggcttcctgggcctaccctcgttctgctactcatggaccagtgtgtttgcctctggaagcctctgtctcctcggctgtaaagcgggcctacgacattgaccgaccacccatgaggttgtggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctaga

SEQ ID NO: 7213 - DNA, 1659 bp, Homo sapiens
agggaagtggggtggctccccatggcttctcccggggctggcactgaagctggagcacaggatgtgctgacgggggtccagaggcagagtccttaacttactcagcttaagcgtggcatgagtcccaactgggaggggccctggcagcatgaaacccccacccccactctctgcgacggcccagatggagggcaggaggaacagcggttcagccctggctggggctgcaggggctggggtgtgttactcactggcacgatggagaactgcatgaagaggcagcggagtgctgtctgtccccacccttccccgcccggcctccaactggtgggaactggattttgcggctgcagaggacttccccaaattttgccacattaacagctgactgcacatctgagccccgaggtgaagcagggcctcaggtagccagggaactggttgagcagaggaaatcggagagacctttttttttgtcatgaacaggctcagtgtgaatgggggaacttcctggttctgagggaatgtgggaaaattgccctttaggctgggtgaagaagaaagcaagtggaaccctggcacccctggacttcctcctccagaggaagcggctttggttgtgggccagcgagcctgtgcgtccccagccccagggcattcaccgcttcagagaagcaaggcgacagttctgccggatgagaggatccaggctgactggaggaaggaagggctttggctcatctgggctcaggtttgggagaggtggcttctcagaggaggtgatgcctcagccagtcttaaaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctagacagatgtttgcttgcttctgggcccattgggcctcctctcagagcctggaactcccagcccccagctcctggggtgccttcctccaggtgtgtccctggcttgggctggggggacacagccccgctcctgggacgtgcaggtttaaaatgctattgggtaccatctttgatcgaattcagagtgacagacttagagcaggtcacctctcagcttctaacgaggccaagacggaggaatccccacagcactgggtttgactctgtaattaagctggtaaagtggaaaaataaaagtaggaaacctaagtggaaacc

SEQ ID NO: 7214 - DNA, 2673 bp, Homo sapiens
aacctgaagctctcagagcttccctgtcttcatctatcagcccagggagaggaatcagtggttttccaaaagctgtacctctttccataaatacaaggatgaagggctgagatgatggcagttagaattatattgagaaatggtagcgggatctgagaaagcaaggccatgagttgaaagcagagagaaggcggttcgagtggagccctgatgaagttcatgctcatggttgcccagccattaacacgggctcatcacatctgtttccagattgcttctagaacttagctaccctcgttctataagatggaatgaaaatgcgtactacatacagatcatgaaaagacgcaaagaaaatgcatcttcacattgcagttcagaatcacgccggcctcattctaccgctgctctctcctggatctcggccacggatcttttgctcgcgaaagttcctccgtctagctgcacacaacgctgctgcaggaaaccgaggtaagggatttgccgagacttagctccaccacactccccgaggccccgcccctcctctctggccctcccctaggcccaggtgtctcgcgttgcacgtgcagttgttgtggttctacgtcacgtggtcccggaagttcaagacagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagtaa

SEQ ID NO: 7215 - DNA, 924 bp, Homo sapiens
ctgctggtggccctgctgggtgggggcctgcctgctggcttcgtgggccccctttctcgtatggcttaccaggcttccaacctgccctcgctggagctggtcatctgtcgatgcctcttccacctccctattgccctgctacttaaactgcgtggcgacccccttctgggacctcctgacatccgaggccgcacctgcttctgtgccctgctcaacgtcctcaacattggatgtgcctatagtgcggttcaggtggtgcccactggcaatgctgccactgttcgcaaacattcttccaccgtctgctccgccatcctcaccctctgccttgagagccaggttctcagtggctacgactggtgtggactgttgggcagcatcctaggactaataatcattgtgggacctggactctggacactacaggaggggaccacgggtgtctacaccggcctgggctatgtgcaggctttcctgggaggactggcgctgtccctggggcttctcgtctatcgttctctgcactttccctcctgcctcccaacagtggccttcctatctggcttggtggggctgctgggctctgtgccaggcctctttgtgctgcagtcccccgtgttgcccagtgacctcctgagttggagttgtgtgggggcagtggggatcctcaccttggtctccttcacatgtgtgggctatgcggtcaccaaggcccaccctgccctggtgtgtgctgtcctgcattccgaggtggtgatggcccttatactgcagtattttatgctccatgagactgtggcaccttctgacatcatgggggcaggggttgtgctgggcagcattgccatcattacagcccggaacctcatctgtgagaggacagggaaggtggaggagcaaagactgaagacaaaaaaaaaaaaa

SEQ ID NO: 7216 - DNA, 1195 bp, Homo sapiens
ctcaggagagttccagggaagaaccccacccccactccaaccatgtcacaatggctggagctctgaggggcccaggctccctgagccaggaggagaggagaaagtccaaggaaagatggctggcagtcacccctacttgaacccgcctgactccacacacccatcgccgccctccgctccacccagcctccgctggcaccagtgctgccagccctctgatgccaccaatggcctgctggtggccctgctgggtgggggcctgcctgctggcttcgtgggccccctttctcatatggcttaccaggcttccaacctgccctcgctggagctgctcatctgtcgatgcctcttccacctccctattgccctgctacttaaactgcgtggcgacccccttctgggacctcctgacatccgaggccgggcctacttctatgccctgctcaacgtcctcagcattggatgtgcctacagtgcggttcaggtggtgcccgctggcaacgctgccactgttcgcaaaggttcttccaccgtctgctccgccgtcctcaccctctgccttgagagccagggtctcagtggctacgactggtgtggactgttgggcagcatcctaggactaatcatcattgtgggacctggactctggacactacaggaggggatcacgggtgtctacaccgccctgggctatgggcaggctttcgtgggaggactggcgctgtccctggggcttctggtctatcgttctctgcactttccctcctgcctcccaacagtggccttcctatctggcttggtggggctgctgggctctgtgccaggcctctttgtgctgcagccccccgtgttgcccagtgatctcccgagttggagttgtgtgggggcagtggggatcctcgccttggtctccttcacatgtgtgagctatgcggtcaccaaggcccaccctgccctggtgtgcgctgtcctgcattccgaggtggtggtggcccttatactgcagtattatatgctccatgagactgtggcaccttctgacatcgtgggggcaggggttgtgctgggcagcattgccatcatcacagcctggaacctcagctgtgagagggaagggaaggtggaggagtgagatagaacttgggagcccgggggttgggagggacagggataaatagaggcaaagactgaagac

SEQ ID NO: 7217 - DNA, 1308 bp, Homo sapiens
atggagggacagaccccaggaagcaggggccttccagaaaagcctcaccctgccacggctgctgccactctgtcctcgatgggcgctgtcttcatcctcatgaagtccgcgctgggagctggcctgctcaacttcccctgggccttctccaaagcgggcggagtggtccctgccttcctggtggagctggtctcgttggtcttcctgatcagcgggctggtcatcctgggctatgctgctgctgtcagtggccaggccacctaccagggtgtggtcagggggctgtgtggccctgccattgggaagctgtgtgaggcctgcttcctcctcaacctgctcatgatctccgtggccttcctcagggtgatcggggaccagctggagaagctgtgtgactccctcctgtctggcaccccgcccgccccgcagccgtggtacgcagaccagcgcttcaccctgcccctgctctccgtgctggtcatcctgcccctgtctgccccgcgggagatcgccttccagaaatacacaagcatcctaggcactctggctgcctgttacctggccctggtcatcaccgtgcagtactacctctggccccagggcctcgtgcgtgagtcccatccttcactgagccctgcctcctggacctctgtgttcagtgtcttccccaccatctgcttcgggtttcagtgtcacgaagctgccgtctccatctactgcagcatgcgcaaacggagcctctcccactgggccctggtgtctgtgctgtccttgctggcctgctgcctcatctattcactgacgggggtttatggcttcctgacttttgggacagaagtttctgctgacgtcttgatgtcctacccaggcaatgatatggtcatcattgtggcccgggtcctttttgctgtctccatcgtaactgtctaccccatcgtgctcttcctggggaggtcagtgatgcaggacttctggaggaggagctgcttggggggatgggggcccagcgccctggccgacccctcagggctgtgggtccggatgccgctgaccatcctgtgggtcaccgtgacgctcgccatggcgctgtttatgcctgacctcagcgagatcgtcagcatcatcggaggcatcagttccttcttcatcttcatcttcccaggtttgtgcctcatctgtgcaatgggtgtcgagcctataggaccaagagtcaagtgctgcctggaggtctggggagtggtctctgtgctggtcggcaccttcatctttgggcagagcacggcggcagcggtctgggagatgttctga

SEQ ID NO: 7218 - DNA, 3546 bp, Homo sapiens
tgatagggcagagaggagcccatgctccagctgcggggagtgcctgcccgaggagctggccagtgaagacaggtgcctgccagtgaagacaggtgcccacaagctggacacagggtcggccctgagacaggacagcagctgcggaatgttcccgctggctttctggagcgccagcgtcctgcttgggtctggccaggggcctctagccaggctgttgaggcgcccctccttgttgaagaggagaaacagtggccccctgggagttgctgggaggtgcctggcacagggcggcagggacagcatcatctatggggaaagcaagcccagcctcagggctgtcccgtccaaagacccttgtgagtccactgaggtcaaatcaatggagtcttcagaaaggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagaacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaa

SEQ ID NO: 7219 - DNA, 3367 bp, Homo sapiens
actgcgagaccatcagcgaggggtccatagaccgaatccccatgcgcctgtgggtgatgcacggggcggtgatgtttggcagggagttctgttacgccatggaaaccgctctggtcacaccaatactgttgcagattggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtgacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtag

SEQ ID NO: 7220 - DNA, 3470 bp, Homo sapiens
atgaaaatggctccgcagaatgccgacccggaatctatgcaagttcaagagttatccgtgcccctgccggacccgcagaaagccggaggcgcagaggccgagaactgcgagaccatcagcgaggggtccatagaccgaatccccatgcgcctgtgggtgatgcacggggcggtgatgtttggcagggagttctgttacgccatggaaaccgctctggtcacaccaatactgttgcagattggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtgacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtag

SEQ ID NO: 7221 - DNA, 7483 bp, Homo sapiens
agggcagagaggagcccatgctccagctgcggggagtgcctgcccgaggagctggccagtgaagacaggtgcctgccagtgaagacaggtgcccacaagctggacacagggtcggccctgagacaggacagcagctgcggaatgttcccgctggctttctggagcgccagcgtcctgcttgggtctggccaggggcctctagccaggctgttgaggcgcccctccttgttgaagaggagaaacagtggccccctgggagttgctgggaggtgcctggcacagggcggcagggacagcatcatctatggggaaagcaagcccagcctcagggctgtcccgtccaaagacccttgtgagtccactgaggtcaaatcaatggagtcttcagaaaggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtggtctgagccgcactcccgtttacacacattccagtgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacaaggcccgtgcacacagcatgttgggggcccagcccaaagttcttgtcacctcctcatgcaaagccagccatcaccctccggccagagctcaaggtggccccttggccagcccctccttgggtcctccaggaggactgagcacccctcctagcggcatcccttgccctccacagtgctgccaggggcacgtcgctctgtgccgtggactgagaccatcccctggtgacagaatgacccgtttgttggaaatgcctcgttgccagagaaactccccaggcatctcggaacgaaactatttagttccattgtgaactggccacgggacagctttttatcaacttattaagttggagcactgtaatcgcgcttgctgagttagcagtggtggtaagcgtgtgttaaacacataatgttacgttttaggagagagaggtcgtaaggaagtgtcgtgtcgctcatgactctcttctattagttgggtaacagtggcctcatgtttgtgtctgtgtgtacacagagcccttaggttctgctctgtttctttgccaggtgaatgtttgtggcatgcgctgctgtccgcgcccctctgtcctgcgcagggttcagctgtgcggcgccctgatttcctccatgcacacagaacctccttgtgtctgtttctctgttcctctgtggctgactcaataaacttttccctctgacatgatga

SEQ ID NO: 7222 - DNA, 1757 bp, Homo sapiens
gggcgggacttccggtcgtgggccatgccgggggcgggcccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 7223 - DNA, 1777 bp, Homo sapiens
atgccgggggcgggcccggaaccgccacgggtgagtcgggtcgtggctgctgccgggtcctgcgcgctccggactgagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 7224 - DNA, 1896 bp, Homo sapiens
ggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 7225 - DNA, 1923 bp, Homo sapiens
atgaaaatatcaaccactcaaatagaaaggagatttgagatatcctcttctcttgttggtttaattgatggaagcttcgaaataggaaatttgtttgtgattgtatttgtaagttactttggatctaaactacacagaccgaagttaattggaattggttgttttcttatgggaactggaagtattttgatggctttaccacatttcttcatgggatattacaggtattctaaagaaaccaatattgatccatcagaaaattcaacatcaaacttaccaaactgtttaattaatcaaatgttatcactcaatagaacaccgtctgagataatagaaagaggttgtgtgaaggaatctgggtcacacatgtggatctatgtcttcatgggtaatatgcttcgtggcataggggaaacccccatagtaccattggggatttcttacattgatgattttgcaaaagaaggacattcttccttgtatttaggtactgtgaatgtaatgggaatgactggtctagtttttgcctttatgctgggatctctgtttgctaaaatgtatgtggatatcggatatgtggatctgagcactatcaggataactcctaaggactctcgttgggttggagcttggtggcttggtttccttgtgtctggaatagtatccattatttcttctataccattctttttcttgcctctaaatccaaataaaccacagaaagaaaggaaagtttcactatttttgcatgtgctaaaaactaatgataaaaggaatcaaatagctaatttgaccaaccgaagaaaatatattaccaaaaatgtgactggctttttccagtctttgaaaagcatccttaccaatcccctgtatgttatatttgtaatttttacattgttacacatgagcagctacattgcttctcttacttatatcattaaaatggtggagcaacagtatggttggtctgcatctaagactaactttttgttgggagtcctcgccctacctgctgttgcaattggcatgttttcaggaggatatatcattaaaaaattcaaattgtctttagttggacttgccaaattggcattttgttctgcaacagtgcatctcttatctcaagttttatatttctttctaatctgtgaaagcaaatcagttgccggcctaaccttgacctatgatggaaatagtccagtaagatctcatgtagatgtaccactttcttattgcaactcagagtgcaattgtgatgaaagtcaatgggaacccgtctgtggaaacaatggaataacttacctgtcaccttgtctagcaggatgcaaatcttcaagtggtaataaagagcccatagtgttttataactgtagctgtgtggaagtaattggtctccagaacaaaaattactcagcgcacttgggtgaatgcccaagagatgatgcttgtacaaggaaatcttacgtttattttgtaattcaagtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaa

SEQ ID NO: 7226 - DNA, 2064 bp, Homo sapiens
atggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattacaggtattctaaagaaaccaatattgatccatcagaaaattcaacatcaaacttaccaaactgtttaattaatcaaatgttatcactcaatagaacaccgtctgagataatagaaagaggttgtgtgaaggaatctgggtcacacatgtggatctatgtcttcatgggtaatatgcttcgtggcataggggaaacccccatagtaccattggggatttcttacattgatgattttgcaaaagaaggacattcttccttgtatttaggtactgtgaatgtaatgggaatgactggtctagtttttgcctttatgctgggatctctgtttgctaaaatgtatgtggatatcggatatgtggatctgagcactatcaggataactcctaaggactctcgttgggttggagcttggtggcttggtttccttgtgtctggaatagtatccattatttcttctataccattctttttcttgcctctaaatccaaataaaccacagaaagaaaggaaagtttcactatttttgcatgtgctaaaaactaatgataaaaggaatcaaatagctaatttgaccaaccgaagaaaatatattaccaaaaatgtgactggctttttccagtctttgaaaagcatccttaccaatcccctgtatgttatatttgtaatttttacattgttacacatgagcagctacattgcttctcttacttatatcattaaaatggtggagcaacagtatggttggtctgcatctaagactaactttttgttgggagtcctcgccctacctgctgttgcaattggcatgttttcaggaggatatatcattaaaaaattcaaattgtctttagttggacttgccaaattggcattttgttctgcaacagtgcatctcttatctcaagttttatatttctttctaatctgtgaaagcaaatcagttgccggcctaaccttgacctatgatggaaatagtccagtaagatctcatgtagatgtaccactttcttattgcaactcagagtgcaattgtgatgaaagtcaatgggaacccgtctgtggaaacaatggaataacttacctgtcaccttgtctagcaggatgcaaatcttcaagtggtaataaagagcccatagtgttttataactgtagctgtgtggaagtaattggtctccagaacaaaaattactcagcgcacttgggtgaatgcccaagagatgatgcttgtacaaggaaatcttacgtttattttgtaattcaagtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaa

SEQ ID NO: 7227 - DNA, 2315 bp, Homo sapiens
ccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtattt

SEQ ID NO: 7228 - DNA, 2402 bp, Homo sapiens
ccctcacccggcacctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtattt

SEQ ID NO: 7229 - DNA, 1426 bp, Homo sapiens
gtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccatgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccact

SEQ ID NO: 7230 - DNA, 1601 bp, Homo sapiens
attcgccgtccctcacccggcacctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagaccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcac

SEQ ID NO: 7231 - DNA, 720 bp, Homo sapiens
gctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgagacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgact

SEQ ID NO: 7232 - DNA, 2376 bp, Homo sapiens
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaag

SEQ ID NO: 7233 - DNA, 428 bp, Homo sapiens
atgactgcagcagcatccttgctggcctctctgcttcctgcattgcctcctctgaatcttcaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtgatgggattacaggtcggaatgtacggattgtttcattttggggtaatgatggatcagccacagccaagccttacccgtgctgacgaatctccatgtgatcgtgtcctttctccatgtgctgcccacagaaagcagcgagactgctgtctcagctggaaagctgagcctgagagatttctggttaaaaaaaaataaaaaataaaaatctcctgcctaaggaaata

SEQ ID NO: 7234 - DNA, 2248 bp, Homo sapiens
ggcagccgcagaagcggcagcggcggcggcgcggcgcaggcaccggcccggggagaggcaccatgagcggatcacagaacaatgacaaaagacaatttctgctggagcgactgctggatgcagtgaaacagtgccagatccgctttggagggagaaaggagattgcctcggattccgacagcagggtcacctgtctgtgtgcccagtttgaagccgtcctgcagcatggcttgaagaggagtcgaggattggcactcacagcggcagcgatcaagcaggcagcgggctttgccagcaaaaccgaaacagagcccgtgttctggtactacgtgaaggaggtcctcaacaagcacgagctgcagcgcttctactccctgcgccacatcgcctcagacgtgggccggggtcgcgcctggctgcgctgtgccctcaacgaacactccctggagcgctacctgcacatgctcctggccgaccgctgcaggctgagcactttttatgaagactggtcttttgtgatggatgaagaaaggtccagtatgcttcctaccatggcagcaggtctgaactccatactctttgcgattaacatcgacaacaaggatttgaacgggcagagtaagtttgctcccaccgtttcagacctcttaaaggagtcaacgcagaacgtgacctccttgctgaaggagtccacgcaaggagtgagcagcctgttcagggagatcacagcctcctctgccgtctccatcctcatcaaacctgaacaggagaccgaccccttgcctgtcgtgtccaggaatgtcagtgctgatgccaaatgcaaaaaggagcggaagaagaaaaagaaagtgaccaacataatctcatttgatgatgaggaagatgagcagaactctggggacgtgtttaaaaagacacctggggcaggggagagctcagaggacaactccgaccgctcctctgtcaatatcatgtccgcctttgaaagccccttcgggcctaactccaatggaagtcagagcagcaactcatggaaaattgattccctgtctttgaacggggagtttgggtaccagaagcttgatgtgaaaagcatcgatgatgaagatgtggatgaaaacgaagatgacgtgtatggaaactcatcaggaaggaagcacaggggccactcggagtcgcccgagaagtaagtttgtgtgtaaggtggagtctcaccgtcccccaggctggagtgccgtggcgtgatctcagctcactgcaacctccacctcccgggttcaagctattctcctgcctcagcctcccgagtagctgggattacaggcacctgtcaccacacccagctaatttttgtatttttagtagagatggggtttcaccatattggccaggctggtctcaaactcctgacctcaagtgatctgcctgccttggcctcccaaattgctaggtttacaggcatgagccaccacgcccagccttcccttgcacttttaatgagggggttaagttcactgttttctctttctatggtattgggtaaaataggtctgcaagctttatatttgcccagggtatcattcattcttcaggtgttgatttaggagtgttatttggaaggagtattatttgctcttcccctgagaactgaaagaggggaaaggagtacatttgagggcacttaatacaaagttaatgtcagaatgtgtgccttgaaattcttgctttatacatacatctgtcattttcatttcacagggttcacagggtttcacagtctgatgagactgtgcctgttattgttttttatttttactctggattttccttgcatctgacttgccactagcacaggaagctcaggacgaaggcagcgttaggagaatagttgtggtatggtgacttctgtgtttatctgcaggggtgtgaatagccgtaacttgcctgcacctgctgccttaacagtggagttggccaggcgcagtggctcacacctgtaatcccagcactttgggacaccaaggtgggtggatcacctgaggtcaggagttctagaccagcctgaccaacatggtgaaaccccttctctacgtataaaaaaatacaaaattagccaggcatggtggtgcatgcctgtaactccagatacttgggatgctgaggcaggagaatcgcttgaatatgagaggcggagccaagatgatgccattgcactccagcctgggcaacaagagagaaggtccttctc

SEQ ID NO: 7235 - DNA, 7002 bp, Homo sapiens
ggggccactcggagtcgcccgagaagccactggaagggaacacctgcctctcccagatgcacagctgggctccgctgaaggtgctgcacaatgactccgacatcctcttccctgtcagtggcgtgggctcctacagcccagcagatgcccccctcggaagcctggagaacgggacaggaccagaggaccacgttctcccagatcctggacttcggtacagtgtggaagccagctctccaggccacggaagtcctctgagcagcctgttaccttctgcctcagtgccagagtccatgacaattagtgaactgcgccaggccactgtggccatgatgaacaggaaggatgagctggaggaggagaacagatcactgcgaaacctgctcgacggtgagatggagcactcagccgcgctccggcaagaggtggacaccttgaaaaggaaggtggctgaacaggaggagcggcagggcatgaaggtccaggcgctggccagagagaacgaggtgctcaaagtccaactgaagaaatatgtaggagctgtccagatgctgaaaagagaaggtcaaacagctgaagtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcaggtctacatccggataaaagacgatgaatggaatatttatcgccggtatacagagttcaggagtttgcaccacaagttacaaaacaagtaccctcaagtgagggcctacaacttcccacccaaaaaggccattggaaacaaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtcgacatcaccccgcccggagagcctgtgaacagccggcccaaagcagcttcccgcttccccaaactgtcccggggtcagccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgcatgataccgtgacccgagagaccaaggcagcacctcgctggagagactgggacacacagtccttctgcttctggggtctaccctgggctgcaagggctgttcctccacctttctgtagttcagggctggcaggagggtgggcaccaggtcaggctgggtgcgccatggttgagaggcaaaggtgatcccctatataggaaggttcatgcagagccagcctctccactctttcccacgtggggactagaatgactattagcctctccttttgctttttaaggttattacctggcctaacctagggatggctggctttgcgggggggggggggggggggggcatggttcctttcactgcattttccaccaacagtcattagacacctggcactgtcacagctcacttttccagagggatattcctgtggctttggcaaggagccattagtgatgtgcaacttgagttcagagaacttcccctacctcccccatggctggcttcaggaaggaccagtgccctccatagcctgaggccacctaggccctcgccaggcttggagtggggggactcagacatctggcccagccatcagcagcaacctagtaacccggcgtcatccagcgtgtccaaagtagcattggccctacagtcatgagagacttgggtcagggaaccactgcagaaggttccagggttttcaaaccaggctccatgactatgaagttggacccagtgtggacacttaacagatcatgtgtctctccactaaaaacattttccatcccgtctgcccccgacattgtccttgataacagaactctgcatcccctaagacagagtcctctgttcctcccatgtcaggtggctctcagagtacagggaccttggcaggtggagaggaggatggggaccagcagctgggcagcccccagggctcctcctccagtgagctcacatcagagcacctcacagagcaatagccgtcctcagatgctcagcaaagttgtggcagtttgcatttctagggtaaactaactaggaaggatgtcgtgaaatggactatgcaagagtaagtttgtgtgtttcgccttaatctgaggcagagacacagcagaacctgaggagaaaagcaggtggaaggtgacggttagatggtaagccatgggcttgtcctggaactgcttcaactcagtggcttaaaatgagaactgcccaggtgagcatggagcatctcctaggctcgaggacatctctggagaatcatctggaaggtttatactgtgccttcccctcgtagcaaaaaggaagattgttcatggcctttaaggaaggctgagatcactcacacacagcgcccccccaccccagagaaaccgagtcagcctacatgacttccaaggggacctggggccagataagccctgccccggtgagaccaaatgagctggagcatgtatggaggtgcggaccctgcagtcagtttgcgagtgtggaggacccgagacatcctgtaaaggcaacttggtctccctcccactcacctgccaacattgctgcaatacacatggtttatctgaaattccaaggccagagtgcacatcagctcacatgactggcaactctaaatagagagccctaatggactgaggcaggaaacgtctaaaagctcaatctgctgtatgtcatgaccccttaggttgggtttatgccacatcggtcattttgaagtaggtgtttgatgccagctcagagactgtctcaggagtgcctccctggcctgggtagctaccctggaggtcatctccctgttctctgttggataaaggaacctcccccatctgtgacattcccttgggcccaggcttatgacctgcaccttttctgacacctgcccccaaagcacaggatgtgaattggtctctctccagataccccacgaggaagcaccttggacattctgcacatgataataatgcaacagtcccccattgctgagagatactaacccgtgagaaacaagtatgctctcagctggtattgaactggtgggagaaactgcctcctacttttataatactgaattattcacaaaaaacctggtctgctctccaaaatgagagcatgttcctgggagccacatggggaccatccccagctgcctgctcctggtacctcccccatgatcatgcacagaccgtagagtcgagtcatctcgcagatccagaccatctcctctcattctcactctaaaaatgctggtggcccgcacatgacagcaactccccgaagccttccctttggaatcccatagaatgttctgcaatgattgggtccatcttgctgctcagaagaatcccgtcctgctctctagtgtggtgggatgaacttcaggcaacaaacaactggcagggttcccagttcctggagttatggagcagaaacacccaggcctagcagaattgtggctgaaacctggtgcccaaattccacaccctggaaatgtgtcaactgcctgtcagcctggattcaattctgagggctaagccacgaccttatccatgagtggcgaagacacccctgaggaaaggattgcttgcacctcacatctgtcttcttctaagattactcggagattttcaaacaacatctgagaacagaagccccctcccctactcagagaggaacgagggtggcccacctctcaagggccttggattcctgggaccaccctttgctgggaggaagaatccacaccgaatccttctgtcttcatggcctgctgtgctgaaacagaacagcaggttccatctttcacatctttttttctcccccagatgaaagacgactcaggaacggtagggctgggcagaggtgtctctccttgagagacaacaaaagcttctaagggagggagcttaaaggctgctagaaacctagcccaaccatccactcctgatctgagacagaaccttctccgccactcttcctgcaatcagtgtgaaattccagcttctttgattcccacttagcagtatgctccaatcacgttgctggcaaggcattttagagtttggagctgaggttcaaagccccctgcatttctctactggcaggccctggtgaaggaagacactttcagggaagaggctcttacagtctatggtggtagccatcttcacatccagtcaccagttgcatctagggagctgctggctataaaagggatcatccagtggagttgtaaacaagggaaccatcttgcaagatctaggaagaggaaggggagggatgtggactgggtctgatcacagcccttggccctgcttcatactttggagcttattaagatcaattttgataaccatgtaatttcttagaaccatggcaggtagtattgtgctttaaaaaccagaggctcctgaaagtcgtttacaccaggtggattgataccatggctgtagctgatgcaactaacaagtactggggccagtgatcacaatccaggttggaaacaggagtgaagcccaccagcctgcctggttgatggacagcaggctctgccttctggaggcggcttatatcccaacagcctgaggcagggctctgtggcccaggccggcagtggctgcctctcttggttctgcatggtacattttgccaaccctgaggaccagttcttggggttccaggcctcggccttcctgctccacgtgctcaagcccccacagggggctgcgacaccatctggctcctcacagggaggtccagccatgttctctgggctcccagtgagccccctcccctccggctacccccagaatccatccttcattcctccaccaagctcctgtgtgagctgcagcacccacacgggggaagccctgcactccagcagcatcttccagccttggcacagaactgatggcaaaggaagggctgggttttcagcttctgggacccgaggaagaccccacctcactcctccttccccagtacatcagactggttaggaggcatcccagaaggggcagcctcatgcccaggtttcagccctaaaggtaatgattgtcttgactctgccttggcatttcgctcggaatcacggcagacttggagtgtttcttcaaggcaggcatctgcttatgagcaaggtcaaagatttttcaaaatattgtgcattaattcattaaagctactgttaaatatttgctgtttttagattggcgtccgtgctaattctgcagttgtagcactgtatattttatctcatttctgtgccaagaaagttcatctttatgtttttctaatacacaatcttgatcttgtttccaaaataaagcttcagctccttggtcaatagaagtaagggtgtagccatccagggtctcccggctctaggcagaccggatcccgcagttcatcccatggttgttgaaatgtacctcgatcagtcatctctggtattcctcactctagccatgagccattgccatcttatgggcccgatttgggtactctgaattatgtcatggagtagacagttacttctaaatcccagcaaccaagttgcgtatccttccttatagctagtttctatagagaagtgaaaaagaaatctggcttccttaataagatagttgagcctatgacattaaggagcagcgctgctggcggaagattctagattcactggtggtttaagaggcccagggatttagttcttactggtgcgtaagtgttttcccatcctaaccggaaaaccactcacccaggcttcccccacttcccctcaaattttctcagctctgccgctggtctccatgaacggcaaggggaaccaccactcattcactgtcagtgtaggtaagacagaggatgcccttgcaaaaattgggactgaggacagtagcacacggaatggtggatcgtacatttgcacccagagctactaaacgctcagtgaccccagagaccattaatttcccggagtgaaggggatgggggtagagctaattggaatttttattatccaggactcatcctaagaagaatgttggcctctcttcatccctggcttagccgtcaggtagaacgcttactcacctgacaccgacttcttagagaagcgagtcttttttgaatggaggagcgatggtaaccccactagggggcgcccatgatcggctcccagtgcacccccttaagggtaagcaggccacatatctagagtctgatagtctgtgtgtacataaggtctagaagtctgtggaaacgccctgaaacctgtagtattatcttaactaccctcttatgttaaggtttacataataggatttttaaacaaatgtgtttaattttttaagatctcttgtattaaaattttcttttggaataagctgtggaaattttgttacaacctggttgagatcaacctctttacaatgacacaaattgtgacattttataaattagatacttcagtgg

SEQ ID NO: 7236 - DNA, 1283 bp, Homo sapiens
ggggccactcggagtcgcccgagaagccactggaagggaacacctgcctctcccagatgcacagctgggctccgctgaaggtgctgcacaatgactccgacatcctcttccctgtcagtggcgtgggctcctacagcccagcagatgcccccctcggaagcctggagaacgggacaggaccagaggaccacgttctcccagatcctggacttcggtacagtgtggaagccagctctccaggccacggaagtcctctgagcagcctgttaccttctgcctcagtgccagagtccatgacaattagtgaactgcgccaggccactgtggccatgatgaacaggaaggatgagctggaggaggagaacagatcactgcgaaacctgctcgacggtgagatggagcactcagccgcgctccggcaagaggtggacaccttgaaaaggaaggtggctgaacaggaggagcggcagggcatgaaggtccaggcgctggccagagagaacgaggtgctcaaagtccaactgaagaaatatgtaggagctgtccagatgctgaaaagagaaggtcaaacagctgaagtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcaggtctacatccggataaaagacgatgaatggaatatttatcgccggtatacagagttcaggagtttgcaccacaagttacaaaacaagtaccctcaagtgagggcctacaacttcccacccaaaaaggccattggaaacaaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtggactggatctcactgtttggaaatggccgcgatagttcacgtgaggagttctcatcctcttag

SEQ ID NO: 7237 - DNA, 1209 bp, Homo sapiens
aagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcctaagtagctgggattacaggcgcctgccaccacacccagctaatttttgcatttttagtagagaaagggtttcgccatgttggccaggctggtcttgaactcctgacttcaggtgatcctcctcgcctgccttgcctcccaaagtgctgggattacaggcataagccaccacgcccggccctgcctcttgagctggggagttcaagaccagcctgggcaacataatgagatttcagctctattaaaaataataataatt

SEQ ID NO: 7238 - DNA, 6046 bp, Homo sapiens
agaagggcgctgagaagggagctggaaggaaaagaaggaaacattccttcctcaactggaggaagacacgcggccacacacagaaccagcggccccaggaccgtcaccctgcgtgcccgggcctgtccctcctgaccccaggattatagtggcgaggcagggtgttagccaagcggattgagccaggacacaacaccgcggagccctgcaggcgagtcctccggaggctgagagcaaacggctgcactaggaacccagcagtcagaccggcccccaccctggagtgaacacatcgccactgccaggcatcgcagggaggattaccccaatggcacctggctgggcgacgagaacaaccccgagatgcgggtgcactgcgccatcatcccctccgacatgctgcacatcagcaccaactgccgcacggccgaggagatggtgctcacgctgctggactacctcttccaccgcgaggtgcaggctgtgtccagcctctcggggcagggcaagcacgggaagaagcagctggacccgctcaccatctatggcatccggtgtcaccttttctataaatttggcatcacagaatctgactggtaccgaatcaagcagagcatcgactccaagtgccgcacggcgtggcggcgcaagcagtggggccagagcctggtggtcaagagcttctcgtggagaatgcccaactcatcctcctactgcccctcagagccgatgatgagcaccccacctcctgccagagagctcctgcagccacagctgcagccgcaggccctgcactacgcgctggccaacgtgcagcaggtgcagatccaccagatcggagaagacggacaggtgcaagtaatcccacagggacacctccacatcgccaaggtgccacagggggagcaagtccagatcacgcaggacagcgagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacagagtctcgctctgtcgcacagtctggagtgcaatggcgtgatctcggcccactaaaacctccacctcctgaatctaagcaattctcctgtctcagcctcctgagtagctgggactacaggctcacaccaccatgcccggctaatttttgtatttttagtagggacgaggttttgccatattggtcaggctggtcttgaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaactgtggggtcaggacaatagagagcttcaccatttgcagaatgagaacaggggctcatgatgagtgccaacctattagataatttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccacagtgcaaccaggtgaccttagagtgtaagtacacatgatcgccagctatgctctgtctccaccataggtccaagactgggtagttccggcctggaggtttctgctgcatctgccttctcagtgctcacctaagggcttttgtattttcctcctcgcatccccacagatggggttcaggctgccggacacagctgggtgatgccagggcagtggtcacctgtgccagccctgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcacaaaatctcttggaaacctctaactgtgtctgaaacattagtgcaaatgttgcatcatatttcccatatgtccgcatgttttaggaaaaaaccctcaatttcctaaatatgcaagaaaaatcgatattgtaggacaatgtgactttttaaaaaatgttatttaaaaatcttccccacctccttttctgccctccaagactgccaaatacttgttgaacaaatattattaaaagcctactacgtgccagccatgattcatggtcttggggacacagcagagaacaaactgacaggattcctctcttatgcaactcacattcttatacgataatgataagggttaacattaattaagccgtcaccacgtgttagtcacggtgcagtcattcccacacattattacacttaaacctgctagcaagcttgcaaggtagttagttgtttttcctttaaaaactgagtctcggaatgatgaagcactctgtccaatgtcacacggctagtaagtgtggagaccttgcatccaatcaatgcccgtctcattctaaaggccatgttatgtgttctccagcccatggagaataattttaacacagtcaatgaaatttctacacaacaatgttcttgtttcaagtccaagaatgcctcctacacctcctataatactggctttctggtgagtaaagatggcattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggattttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatacgtgttccaaaaattgcatacatttatacaaatttaatatgatttgtaattttgatagttatgctaaatgtttgctaaagttatatttgtataaacacgtcatgaatggctgggcaccgtcactcatgcctgtaatcccagcactttgggagacaaaggcaggtggatcacctgaggtcgggagttccagaccagcctaatagagtgaaaccctgtctccactaaaaatacaaaaattagccatgcctggtggcacatgcctgtagtctcagctactcgggaggctgagacaggagaattgcttgaacccaggaggcggaggttgcagtgagccgagatcatgccactgcactcccgcctgggtgacagaggtagaatctaactaaaaaaaaaaaaaaaagttattaattatttctgaagattgtatgaaatttataaaagtctggtggccctgatatgatgctgccagtcatgattctgattactgtcttaaaatgctgcacgtaagtaattaaatttccttgtgaactgggaagtttcatcagacttctatcataactattgtttccatcatccacagttactattttgaattcttctctaaaaatatttgtaattggcaatagtccaaattttcttttgttttctttcctgtttttgagacacagtctggctctgttgcctaagctggagtgcagtgagccgagatcatgccactgcactcccgcctgggtgacaaaggtagaatctatc

SEQ ID NO: 7239 - DNA, 1857 bp, Homo sapiens
tcccagctactcatgagcctgaaatgggaagatcgcttgagcccaggagttcaagactgcagtgaactatgatcgtgccactgtgctctagcctgggtgacagagtgagaccttgtccccaccccacccctcaaaaacaaaacaaaacaaaaaaaaacccaaacaaggaaaaggaatgctgtttggtgcacgtgtagtagtgatattaatagttggttttcattgagcaccaattatatgccagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaaaaaaaa

SEQ ID NO: 7240 - DNA, 578 bp, Homo sapiens
tgaaaacacactttaaagcgttcatgtagattcaaggtcggagggaggtgactgcatttttcaagacaggctgcaaagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctggtg

SEQ ID NO: 7241 - DNA, 2451 bp, Homo sapiens
agatgtccccggccggcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattccagtgaat

SEQ ID NO: 7242 - DNA, 1265 bp, Homo sapiens
aattagtgtcagaaaaaatcagggatatgggctttagggatgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaa

SEQ ID NO: 7243 - DNA, 2003 bp, Homo sapiens
gttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagatgcctgcctgcgggccgaccgcgtcatgcgcgcccacaagtgcctggcagacgattatatccctatctcagctgcgctgagcagtctgggaacacaggaagtcaaccagctaaggacgagcttcctcaaattggcagagctctttgaacggctgaggaagctggagggccgggtggcttccgatgaggacctgaagctgtcagacatgctgaggtactacatgcgtgactcacaggcagccaaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaagagctcatggacttcaagtcccgccgggtctcctcttttcgaaagaatctcattgagctggcagagctggagctcaaacacgccaaggccagcaccctgattctccggaacacccttgttgccctaaagggggagccttagagtagccagagctcagccagaccctaatctgggatctccagtgaccagggtatcccagacccctctctccggcaagatgtctccttccctagcagtgccactagccacaccctcactctgccccacatcctctcagggaaagcccaaaccccctatcaccaccaccacaggtgccaggccctgcaagacacagggcagcatgggcatcataactggccacagtcagcagagccccagggaccctgacacctctccccaggaagctgaggaacagcctctaccctcacccatagccctgaaggaatcatagctcacttgatcccggcctgttctccttcgcaaataaaaaccctggttttgtagcaa

SEQ ID NO: 7244 - DNA, 1215 bp, Homo sapiens
gtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagggaaaagctacagaaattgggcgagggggacagctctgtcactcgggaagagtttgccaagatgaagcaggagctggaagcgtgagtgccccctcctttccctgccatccccagagtccagatgtcttccccagctatctccccatgaatgtttagcaaccctgacctctgaccccagaaagggggcaggcaggatgatgggggctgaggagggccggtgagctgctgccactctcgcagggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagatgcctgcctgcgggccgaccgcgtcatgcgcgcccacaagtgagcttcctcaaattggcagagctctttgaacggctgaggaagctggagggccgggtggcttccgatgaggacctgaagctgtcagacatgctgaggtactacatgcgtgactcacaggcagccaaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaagagctcatggacttcaagtcccg

SEQ ID NO: 7245 - DNA, 8008 bp, Homo sapiens
ggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttga

SEQ ID NO: 7246 - DNA, 469 bp, Homo sapiens
gtcaccaggagggtatgcatagggagggcaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccgaccaaatggaggaggaggaattcatagaaataacgactgaaagacctaaaaagtagcaagaagctacatccctcaaacttcggcaatgaaaataaagtttgagaagctga

SEQ ID NO: 7247 - DNA, 682 bp, Homo sapiens
attaaacatggagaaatgaggagcggcggcagatcggtttgggatgcatcttcaggggatgctgaaacaacagcagcatttggtttgctctacacccctgtcacccctcgcccgcaagcccagggagtggtcagcagtggggctttgtgacgtcgaagccaccctagggctgccattggctgggacactgcctgtatgatcaaacaaagctcaagggtgtggctttgccttgtcaccaggagggtatacatagggagggcaagagctccgggccactgagaagattcaaaacctacaaaagcctgccgctgacattgaagaaccaatatatacaatggacaaacaatccagtgccggcggggtgaagaggagcgtcccctgtgattccaacgaggccaacgagatgatgccggagacctcgagtgggtactcagacccgcaacctgctccgaaaaaactaaaaacatctgagtcctcgaccatactagtggttcgctacaggaggaactttaaaagaacatctccagaggaactggtgaatgaccacgcccgaaagaacagaatcaaccccctccaaatggaggaggaggaattcatggaaataatggttgaaatacctgcaaagtagcaagaagctacatctctcaaccttgggcaatgacaataaagtttgagaagctga

SEQ ID NO: 7248 - DNA, 1276 bp, Homo sapiens
acacccctgatttgaaacaagactaggatacatggtaaagaatgtttattcactaaagttttgacagactgaaggccattatttcagattggagataggaaacttaaaagaactacatggacattgggtaaaagaacatgggttgaaatttgcctggcagtagcccaaaagtaaatggtcttcgaggtgcatgtgaaggaactgtaggagggaaatgggataattcacatctccaccaataattacatgtagccacactagcttgggggatttgaggtgagacatctaaaatactaagtcatggtgagggctggaagacaaaagaatgaatcacttcataggaatggctgtggggaagggcttgaaggaatcatcctctgacttccatgtgaaccatgaacattaaacatggagaaatgaggagcggcggcagatcggtttgggatgcatcttcaggggatgctgaaacaacaacagcatttggtttcctctacatccctgtcacccctcccccacaagcccagggattggtcagcagtggtgcttcgtgatgtcaaagccaccctaggactgccattggctgggacactgcctgtatgatcaaacaaagctcaagggtgtggctttgccttgtcaccaggagggtatatatagggagggcaagagctctgggacatcctcctgggaagcttcaatacagctgtgcaagtctggagtctacaagagcctactatagacattctacaaccaaccagaatcatggaacagcccacttcaagcatcaatggggagaagaggaagagcccctgtgaatccaacaatgaaaatgatgagatgcaggagacaccaaacagggacttagcccccgaaccgagtttgaaaaagatgaaaacgtcagaatattcaacagtattagcgttttgctacaggaaagctaagaaaatacattcaaatcaactggagaatgaccagtcctgagagaactccatcaatccagtccaagaggaggaggacgaaggcctagactcagctgaaggatcttcaaagcaggatgaagacctagacttacctgaaggcctagactcagctgaaggatcttcaaagcaggatgaagacctagacttacctgaaggatcttcaaagcagaatgaagacctaggcttacctgaaggatcttcaaagcaggatgaagacctagacttacctgaaggatcttcacaggaggataaagacgtagaattacctgaaggatcttcacaggaggatgaagacctag

SEQ ID NO: 7249 - DNA, 1377 bp, Homo sapiens
acccctgatttgaaacaagactaagatacatggtaaagaaagtttattcaccaaagttttgacagactgaaggccattatttcagattggaaataggaaacttaaaggaactacatggacattgggtaaaagaacatgggttgaaatttgcctggcagtagcctaaaagtaaatggtcttcaaggtgcatgtgaaggaactttaggaggaaatgagataattcacatctccaccaataattaaatgtagccacactagcttggagggatttgaggtgagacatctaaaatactaagtcatggtgagggctggaagacaaaagaatgaatgacttcataggaatgactgtggggaagggcttgaaggaatcatcctctcacttccatgtgaaccatgaacattaaacatggagaaatgagcagcagcagattagtttgggatgcatcttcaggggatgctgaaacaacaacagcatttggtttcctctacacccctgtcatccgtcccccacaagcccagggagtggtcagcagtggtgctttgtgatgtctaagccaccctaggactgccattggctgggacactgcctgtatgatcaaacaaagctcaagagtgtggctttgccttgccaccaggaaggtatacatagggagggccagagctctgggacatcctcctggcaagcttcaatatagctgtggaagtctgcagtctacaagagcctactatagacattctacaaccaagcagaatcatggaacagccgacttcaagcaccaatggggagaagaggaagagcccctgtgaatccaataacaaaaaaaatgatgagatgcaggaggcaccgaacagggtcttagcccccaaacagagcttgcaaaagacaaaaacaatagaatatctaacaataatagtgtattactacaggaagcatacgaaaataaattcaaatcaactggagaaggaccagtcccgagagaactccatcaatcccgtccaagaggaggaggacgaaggcctagactcagctgaaggatcttcacaggaggacgaagacctggactcatctgaaggatcttcacaggaggacgaagacctggactcatctgaaggatcttcacaggaggacgaagacctggactcatctgaaggatcttcacaggaggacgaagacctggactcatctgaaggatcttcacaggaggacgaagacctggacccacctgaaggatcttcacaggaggacgaagacctagactcatctgaaggatcttcacaggagggtggggaggactagtcaaacatggagaaaccaaattggacaaatcctcactaccaatggcgatgattacaataaaatcaagtttgaggagctga

SEQ ID NO: 7250 - DNA, 590 bp, Homo sapiens
atcccactgggaagcttcaacatagctgtggaagtctgcagtctacaggagcctactatagacattctacaaccaaccagaatcatggaacagccaacttccagcaccaatggggagaagacgaagagcccctgtgaatccaataacaaaaaaaatgatgagatgcaagaggtaccaaacagagtcttagcccccgaacagagtttgaagaagacaaaaacatcagaatatccaataatatttgtgtattacctcaggaagggtaagaaaataaattcaaatcaactggagaatgaacagtcccaagagaactccatcaatccaatccaaaaggaggaggacgaaggcgtagacttatctgaaggatcttcaaatgaggatgaagacctaggcccatgtgaaggaccttcaaaggaggacaaagatctagactcatctgaaggatcctcacaggaggatgaagacctaggcttatctgaaggatcttcacaggacagtggggaggattagtcacacatggagaaaccaaattggacaaatcatcaccactgatggcgatgattacaataaaatcaagtttaaggagctga

SEQ ID NO: 7251 - DNA, 431 bp, Homo sapiens
aaagctctgggacagcccactggaaagcttcaatacagctgtggaaatctgcaccctagaagatcctagtacagaaattctacaaccaaccataatcatggaagagccaacttccagcaccaacgagaataaaatgaagagcccctgtgaatctaacaaaagaaaagttgacaagaagaagaagaatctgcacagagcctcagcccctgaacagagtttgaaagagacagaaaaagcaaaatatccaacattagtgttttactgcaggaagaataagaaaagaaattcaaatcaactggagaataaccagcctacagagagctccactgatccaatcaaagagaaaggagacctagacatatctgcaggatctccacaggatggtgggcagaattagtccaaattggacaaatcatcaccactgatggcga

SEQ ID NO: 7252 - DNA, 1316 bp, Homo sapiens
acacccctgatttgaaacaagactaggatgcaaggtaaagaatgttaattcactaaagttttgacagactgaggccattgtttcagattggaaataggaaacttaaaagaactacatggacattgggtaaaagaacatgggttgaaatttgcctggcagtagcccaagagtaaatggtcttcaaggtgcatatgaaggaactgtaagagggaaatgggataattcacatctccaccaataattaaatgtagccacactagcttgggggatttgaggtgagacatctaaaatactaagtcatggtgagggctggaagacaaaagaatgaatcacttaataggaatggctgtggggaagggcttgacagaatcaacctctcacttccatgtgaaccatgaacattaaacatggagaaatgaggagcggcagcagatcagtttgggatgcgtcttcaggggatgctgaaacaacagcagcatttggtttcctctacacccctgtcacccctcccccacaagcccagggagtggtcagcagtggtgctttgtgatgtctaagccacccttggactgccattggctgggacactgcctgtatgatcaaacaaagctcaagggtgtggctttgccttgtcaccaggagggtatatatagggagggcaagagctctgggccactgggaagcttcaatatagctgtggaagtctggactctacaagatcctgctgtagacattcaacaaccaaccagaatcatggaaaagcccacttcaagcaccaatggggagaagaggaagagcccctgtgactccaacagcaaaaatgatgagatgcaggagacaccaaacagggacttagtcctcgaaccgagtttgaaaaagatgaaaacatcagaatattcaacagtattagtgttgtgctacaggaagactaagaaaatacattcaaatcaactggagaatgaccagtcctgagagaactccatcaatccagtccaagaggaggaggacgaaggatcctcacaggaggatgaagacctagactcatctgcagaatcttcaaagcaggatgaagacctacaattacctgaaggatcttcacaggaggatgaagacctagggttatctgaaggatcttcacaagaggatgaagacctagactcatctgaaggatctttgatggaggaagaagacccagactcatctgaaggatcgtcagaggagggtgaggaagactaattaaacatggagaaaccaaattggacaaatcctcaccaccaacggtgatgattacaataaaatcaagtttgagaagctga

SEQ ID NO: 7253 - DNA, 2649 bp, Homo sapiens
tggggaggggaaggagcggcacatggggttgagcagaggagaaaatcagaaagatggcttagagaagtcagcagtctgcgagtctggggaggatggagagtggtttggggttttgggtcggggtctaaggtgatcagatgcagaagcattacacagtggcctggtttctttactcagcccctggggtagatcccagccccccatgtaggtcccttggctggaaaaggaagagggagtggtcagatgaatctgaggaggagccggagaaggagctcgcccctgagcctgaggagacctgggtagtggagacgctgtgtgggctcaagatgaagctgaagcaacagcgagtgtcacccatcctccttgagcaccacaaggacttcaacagtcagcttgcccctggggtagatcccagccccccgcataggtccttttgctggaaaaggaagatggagtggtgggacaaatctgaggagtcggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctccttgctatggtcatagcgtatttcagccgagccggcttcccctcctggcaataccaacgccttcatttcttcctggctctctacctggccaatgacatggaggaggacgacgaggactccaaacaaaacatcttccacttcctgtatgggaagaaccgctctcgcatacccttgctccgtaagcgtcggttccagttataccgttccatgaacccgagggccaggaagaaccgctctcacatacccttggtccgtaagcgtcggttccagttacgccgttgcatgaacccgagggccaggaagaaccgctctcagatagtcctgttccagaaacgtcggttccacttcttctgttccatgagctgcagggcttgggtttccccagaggagttggaggagatccaggcttatgacccagagcactgggtgtgggcgcgagatcgcgctcgcctttcctagagctccagggaccgtggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggagggggatggggtccttctaggagtccttggagaaaagtaagaaaccaggagtgtttccagttccaccctttcctggggcaccaccaccctttttatattgctgaattccaacctccctggggcggaacctggaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttgagacaattctttttatcctaaatattttatcatctttaaatttgtttctgtattattatatgtgctcctgaagcgagcactctttttatctatgatacttccataataatctcttctatttatagctattggtagttcccctaaattctgacgatagaaatttttatttgctgtttaggtttgtgactgaattgtgagaattcagttgtgatttttaacatgtgtcagatatatatactaacacgtctaatatatactattttattggtttattttgaaaaacatgggtatagaattatttaaatattattttatttatttaaatatttattaaatatatttatttatttaaatgttattattactttaaatattattttaaatattttggaaatactggtatttttgaatagatgctgtttctataaagctgtgtgatggtattataactgttatatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttcatctatgtttgaaatgtgagaattcagatgtaattttttaccttgatttggcatgtttgtatgttactttaaagaggatgtgtgttctaaaggaggacatgagctgtgtgttttcaagagaacaatagagtgtgtctcttggggaaacgtaataaaaatgaacttttctcacctt

SEQ ID NO: 7254 - DNA, 1219 bp, Homo sapiens
gggaggatggagagtggtttggggttttgggtcgggctctagtgtgatcaactgcagaagcattacaccgtggcctggtttctttactcagcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccaggggagatgtggattttcagcgggaactttattccaatgctaatggcagacaccaggcaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagcgtttccagttccaccctttcctg

SEQ ID NO: 7255 - DNA, 1683 bp, Homo sapiens
agcagagacagaccccagatctgggcccaggactttgtgcagggaggggaaatactggactctgaaatgggcatgtacagagacgaagagaccccaacatgcttcaggctttgagtggagaggacacagcctctgctgggacagggaatagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgaacgatgacatcagagattccgaccttcctgattggagggaccggactccgtggtgcctggagatcagttggacaacagtatcttctcagagctgttctctactcctgacttctcctaggcttgagaattgataacatactcttctggatcctagaagtgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctag

SEQ ID NO: 7256 - DNA, 1742 bp, Homo sapiens
agcagagacagaccccagatctgggcccaggactttgtgcagggaggggaaatactggactctgaaatgggcatgtacagagacgaagagaccccaacatgcttcaggctttgagtggagaggacacagcctctgctgggacagggaatagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgaacgatgacatcagagattccgaccttcctgattggagggaccggactccgtggtgcctggagatcagttggacaacagtatcttctcagagctgttctctactcctgacttctcctaggcttgagaattgataacatactcttctggatcctagaagtgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccag

SEQ ID NO: 7257 - DNA, 3185 bp, Homo sapiens
ctctgtcggcgcctggcagttcaggtgaacaacagtaacttctcagagctgttctccactcctgacttctcccagcctcgagaattgataacacactcttctggatcccagcagtgtccagaagaagaccaaggacagaacagagactagcttcggtgagattggacagattttgggaaagatcatgacgagccatcaaccgcagccccaggaagagcagagcccccagcggagcacctcagggtaccccctccaggaggtggtggatgatgaagtgtcgggaccatcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcagagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccgcgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagattcctggcctgggacaaagatctgagggtgtcagacaagtatctcctggctatggtcatagcgtatttcagccgggccggcctcccctcctggcaataccaacgcattcatttcttcctggctctctatctggccaatgacatggaggaggacgacgaggcccccaaacaaaagatcttctacttcctgtacgggaagacccactctcacatacccttgcgccctaagcattggttccagttatgccgtcccatgaacccgagggccaggaagaactgctctcagatagccttgttccagaagcgtcggttccagttcttctgttccatgcgctgcagggcttgggtttccccggaggagttggaggagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttacggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaatcattaataggtttatttcaaatagtttggaaattgttgtacttttgaaaacatgctgttcctgtagagttttttgatgagagttatagttgttatatatacataaagataattttcttttcatttttaagtgagaattctttttatcctaaatcttttattatctttaaatttttctctgtattattatatgtgctcctgaagcgagcactctttttatctatgatacttccataataatctcttctatttatagctattggtagttcccccaaattctggtcatagaaatttttatttgctgtttaggtttgtgactgaattgtgagaattcagttgtgatttttaacatgtcttagatatatatactaacatgtctaatatatactatctattttattgatttatttcgaaaaagatgggcaaagaattatttaaatattattttatttatttaaatatttattaaatatatttatttatttaaatatttattaaatatatttatttatttaaatgttattactttaaatattattttaaatattttggaaatactggtatttttgaatagatgctgtttctataaagctgtgtgatgggtattataactgttatatacacataaatataattttgttttcctttttaagagaggattctttttatcctaaatcttttacctttcaatctttgtatctattactacatatgctgctgaagggagcagactttttatctatgatacttagttaatgtatatattacatttatagctatgtggtagttcccctaaattcttgtaaaaataaatttttatttgatattta

SEQ ID NO: 7258 - DNA, 3184 bp, Homo sapiens
ctctgtcggcgcctggcagttcaggtgaacaacagtaacttctcagagctgttctccactcctgacttctcccagcctcgagaattgataacacactcttctggatcccagcagtgtccagaagaagaccaaggacagaacagagactagcttcggtgagattggacagattttgggaaagatcatgacgagccatcaaccgcagccccaggaagagcagagcccccagcggagcacctcagggtaccccctccaggaggtggtggatgatgaagtgtcgggaccatcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcagagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccgcgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagattcctggcctgggacaaagatctgagggtgtcagacaagtatctcctggctatggtcatagcgtatttcagccgggccggcctcccctcctggcaataccaacgcattcatttcttcctggctctctatctggccaatgacatggaggaggacgacgaggcccccaaacaaaagatcttctacttcctgtacgggaagacccactctcacatacccttgcgccctaagcattggttccagttatgccgtcccatgaacccgagggccaggaagaactgctctcagatagccttgttccagaagcgtcggttccagttcttctgttccatgcgctgcagggcttgggtttccccggaggagttggaggagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttacggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaatcattaataggtttatttcaaatagtttggaaattgttgtacttttgaaaacatgctgttcctgtagagttttttgatgagagttatagttgttatatatacataaagataattttcttttcatttttaagtgagaattctttttatcctaaatcttttattatctttaaatttttctctgtattattatatgtgctcctgaagcgagcactctttttatctatgatacttccataataatctcttctatttatagctattggtagttcccccaaattctggtcatagaaatttttatttgctgtttaggtttgtgactgaattgtgagaattcagttgtgatttttaacatgtcttagatatatatactaacatgtctaatatatactatctattttattgatttatttcgaaaaagatgggcaaagaattatttaaatattattttatttatttaaatatttattaaatatatttatttatttaaatatttattaaatatatttatttatttaaatgttattactttaaatattattttaaatattttggaaatactggtatttttgaatagatgctgtttctataaagctgtgtgatgggtattataactgttatatacacataaatataattttgttttcctttttaagagaggattctttttatcctaaatcttttacctttcaatctttgtatctattactacatatgctgctgaagggagcagactttttatctatgatacttagttaatgtatatattacatttatagctatgtggtagttcccctaaattcttgtaaaaataaatttttatttgatattt

SEQ ID NO: 7259 - DNA, 923 bp, Homo sapiens
tgcttgggagttcaggtggacaacagcaacttctcagaactactcttcactcctaacttctcccgagcctctagaagagaaacgcactcttctgggtcctaacggagtctggaagaaggctttggacagaacagggactaggttttgtggacagaaacaaagtgtttgggagagattatggccagtggtcaagcgcgccccccgtttgaggaggagagcccccagcctagcacaacggtacggtcccccgaggtggtggtggatgatgaagtgccaggaccatcagccccttggatagatcccagcccccagcctcaatcccttggcctgaaaaggaagagcgaatggtcagacgaatccgaggaggagctggaggaggagctggagttggagcgcgcccctgagcccgaggacacctgggtggtggagacgctgtgtgggctcaagatgaagctgaagcgaaagcgagcatcctccgtgctccctgagcaccacgaggccttcaacaggctccttggggatcctgtcgttcaaaaattcctggcctgggacaaagacctgagggtgtcagacaagtatctcctggctatggtcatagcgtattttagccgtgccggcctcttctcgtggcaataccaacgcattcatttcttcctggctctctacctggccagtgacatggaggaggacaaccaggccccgaaacaagacatcttctccttcctctacgggaagaactactcccagcgacccttgttccataagcttcgataccagctcctctgttccatgcgctggaggacgtgggtttccccagaggagatggaggagatccaggcttatgacccagagcactgggtgtgggcccgagatcgcaccctcatttcctagagctccggggacatggaggcctgaggtcatcg

SEQ ID NO: 7260 - DNA, 1509 bp, Homo sapiens
atggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccaggggagatgtggattttcagcgggaactttattccaatgctaatggcagacaccaggcaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagcgtttccagttccaccctttcctgcg

SEQ ID NO: 7261 - DNA, 1219 bp, Homo sapiens; identical to SEQ ID NO: 7254

SEQ ID NO: 7262 - DNA, 1742 bp, Homo sapiens
agcagagacagaccccagatctgggcccaggactttgtgcagggaggggaaatactggactctgaaatgggcatgtacagagacgaagagaccccaacatgcttcaggctttgagtggagaggacacagcctctgctgggacagggaatagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgaacgatgacatcagagattccgaccttcctgattggagggaccggactccgtggtgcctggagatcagttggacaacagtatcttctcagagctgttctctactcctgacttctcctaggcttgagaattgataacatactcttctggatcctagaagtgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccag

SEQ ID NO: 7263 - DNA, 3026 bp, Homo sapiens
gtcccctcttctctaaggcctttcgcctagttccagcctggatacgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataaggtacctactgatatgaaataattagaatgctacataataaatcctttttctttaacattaattttgtgatattccttatttcatttctactaataaaaatagacatgttttgtttgcattttcccttgttttaatttgtatgtttgtactactttttagatgcttaaactatacataagctattatctattgttcctagtaatcttaggggagtggtctgaaaaaacatcaagcatagtaattgtctgggtagacagatttcagaatttttaaaatgctttaatttatttattagcatttttctttgtatgggctgtgtacttttgcttcaaaaaccattgttaaaaagtatttcttttgtaatcaatctaaataatagactttttttacaggcaaaatgaaagaggaggaagtctgggttttatgaatagcatagattcaaacaatcttttattcaaagattgaaataaaaagtatcgggtgccaactgtgatttttagaagaactgttgtaaagcctttgagattagacagactagagctacattactgaaattgccaactactaactgtgtgaccttaggtgaccagttcattaagggctaatagatttccatttttcaattaatggaaagggaatgctactatacctacttcatttaaaataacatgagttaaacacttagctgagtgcacttcatgttggatgcatataatacatatccatttctttcctcaccatcctactctccccatcccactccatctcacccttagaagtaaaggtgtaacaatcatagcttttggatagaaattttgagtggatcaacagcaatggaatgaggagtgaggctttttattagaaaaattacaaaatgagtcccggaaggtcagtaagtgcaacatgaaaaaaatctatgaaaagattatttgacctaattattcactgatagtacatactcaacaaaggtttgtgggacaaagggtgaataaaatgaatgaattacaatgaacaaagaaaagtgcaaaataacactaacaagtaaatattacaagaagataaccttgtggttaaaagataaggaaaaatatgagattatgagaaattaaatgtatactatattttaattaaatgaatctgtatttgtagcactaagagaattattattaaggattgactagaaccttaaaagatatatgtggatgtttgttttgtacggttgtaaaatatactagacctattacatccacctaaagtataatgccatgtaagaaaatgctttgacagtatcaacctgtgttaaggtatttctttccattgtaaattaaaagtcattttatttgacaga

SEQ ID NO: 7264 - DNA, 2141 bp, Homo sapiens
aattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaagagtgctctgagaactgctttcaaaggccttcaccttcgacctgtgatgccttctcaaataggagacaggaagtggcttcatggattacaggcagccctccagaactttctcaagggatatcctgcaattgttcggcaactgcactcagcaggcagaggcaaaagtgacaccagtcaaaagaaacccaaagaacttctggagtcccttctccaagctgacattgttaaatttgcccacttcttgttggatgtcatgaatgtccttagcattctgtcctgtgtcaataagaatagaaattcctcaattgctgacatatttgccactttagagtcaatgctggaaatgctccaaatgtatcaaacaagactagggccaaaagaacgcatggtggattcagccacacactttcatggtaactgcctcagagggaaagaaaacatttctgctgtgagaaacattgttttaacacatcttatcaagagacttcaaggctgtttcagagatgccagccaaaatgtggtgagggctaccgtgattggaagttttaaattgtggcccacaaagataaatcaagaatttggagaaaaagaggtatccatcctgactgcacattatgaaccagtattagaagctgccaatgtgaaacttagtgaagtggatactgaatggagcatgttgaaattagagatttatgccagatttcagaacattcgaaaattgacctgggattttgtgaattccatttacttacacaagtatccaaatatcctgacactagtcgacctagtgttgacccttcctgcaagttcagctgaagcagaacatggctttagtcagatgaaatggaccaagtcacatatgcatgcaaaaatcaaggctgaaagcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtg

SEQ ID NO: 7265 - DNA, 5681 bp, Homo sapiens
gtcccctcttctctaaggcctttcgcctagttccagcctggatacgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataagaacatggttggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgaaacaatgcttagtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaatgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagcttccctggctgagcttccacttcctacacctcctcctgctcctcctcctgaaccagaaaaagagaaggaaattcatcaaagccatgtggcttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaacgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaagaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaaggcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtga

SEQ ID NO: 7266 - DNA, 2015 bp, Homo sapiens
actgaaccagtgacaagctgggggaaatgacactgtccagtagttggaggtcacacagccccttgccttattctcaaaccctaaccacatggctggatattcctgaaatgcattcctaaacctctgctgctgagaataattggacctgccatctattcccagtttaactgccctgtataccaaacaaatccaattcaagccaacaggcaaagtataggctcagacagagcccatcctatgtgcaaggcggtgagcaggggtggaaaatctcactgtgactcatccagctgatttctgggctgaacccagacttcacagggctgttaggagaatactgtttacaaaggtttccagcacatggaaggttcctccgtggatgctggcgggcctgccatgatttaaagtggaagaagcaccatcaagatcttcaaggagcacactaggtgatgcccctcacttggcacccgtgttggcgctggcatcatggacaatagaaacacccagatgtacacggaggaggaaaagacagtcaaccccttcctgccatccacgcctggacctaaaaaagcaaaaggagggggtgaggctgtggagacccacccagcaccggggcctcttcctccaccagaggtgagggacattggagagaggcgggagccagaccgtgcgcagcagcagcctcagaagcccgcggtggctgcagggacacagagcctcgggaacttccggcagggcttcatgaagtgcttgctggaggtggagaaaatggaggcctcccatcggagagcctcgaaggcccggtcccagacagcccagaagtcgcccaggaccctgaccccggtgcccacctcagctccaagcctgcctcagacccctgcctcggtccctgccagcggcccatcgtgggcccggctgccagctcctgggccagaacctgcccccatgggagccccggtccccacctccatgccttgccctgtcctgctgggccctgccctggacctgggctggagaaggatggaactcttgcaccagagcagcgagagaaccctgagctacgccaaggcgcggcaggagccggaagagcagagcctccaaaagctttatcaaaaccgggagaagtccgaggagcaactgaccctgaagcaagaggaagccttccgcagctactttgagatcttcaatggtcctggtgaggtggatgcacagagcctgaagaatatcctgctcctaatgggcttctctgtgacgctggcccaggtggaggacgccctgatgagtgctgatgtcaatggagatggtcgtgtggacttcaaagacttcttggctgtgatgacagacaccaggcgcttcttctgctctgtggaacagaacgccctgtcggacatggctccccacaacccccacactctactctttgagatcctgtccctgctggtagagatgctggccttaccagaggcagtcttagaggaaatcacaaactactaccagaaaaagctgaaggaaggcacctgcaaggcccaggagatggaagcggccgtaggccggctgcggttgcagaagcttccctacaacccccagcaagaagagagctcagaagttccagaacgaaaggtcctcagtatcctgagccggctgaagcagcagaactatgctcccaacctgcagagcccctatgcccaggtgccctgcatcctgctctgcccacagctggacaagaagatggtccgtaggcagccgagcaaccactatgcactagaccagtgcacaccccctggcctggatcctgacatccgcagccccttcttccagtcaggatctcaaggaaacagggaacacaactctgacagcagaaagtggctcagctctgtgccagctcgaacccactgaccctctggaggcctgactctaggcagctgctcaaggcctgtagacagatgggccaccaggcaggagctgctgctgggatttgcttttgtggcctggtgagctaataaacaccaataacttca

SEQ ID NO: 7267 - DNA, 1136 bp, Homo sapiens
agtgacaagctgggggaaatgacactgtccagtagttggaggtcacacagccccttgccttattctcaaaccctaaccacatggctggatattcctgaaatgcattcctaaacctctgctgctgagaataattggacctgccatctattcccagtttaactgccctgtataccaaacaaatccaattcaagccaacaggcaaagtataggctcagacagagcccatcctatgtgcaaggcggtgagcaggggtggaaaatctcactgtgactcatccagctgatttctggagcacactaggtgatgcccctcacttggcacccgtgttggcgctggcatcatggacaatagaaacacccagatgtacacggagggtagaaccaaggctccagggacgcagccaagtcctggcctgaggatcaccataaagagggctggtgttgagcccatcataccaggagtcagcaaggtcatgtttccggatgcttcggaagtgggcagcaagaagcacctctcatcagcttcacgagggccagagaaggggcccagactcagagatgcatttgagaaggggccttcagagctcagaatccaggagcaggggcctccagcaagaccagggaagaaacagccctcttgggtcccccaggaagggtcccaggagctgcaagcaggccaggatcagagtgagctggggttgctgccttcctgggttcctgaagtacctgaagggctgcagcagctgggctccggaaaggagatcaagggccagcaggggaggcaacggaaccggggaatcggggaggatcagcctcctgagagctgccaggccgggcatggtggctcacgcctgttaatcccagcacttctggaggccgaaggaggcagatcacctgaggtcaagaccagcctggccaacatggtaaaaccctgtctctactaaaaaatataaaattagccgggtgtggtggcacatgcctgtaatcccagctactcaagaggccgaggcaggagaattgcttgaacacgggaggtggaggttgcagtgagctgagatcgcgccattgcactccaaccagggcaatgagagcaaaactccgtctcaaaaaaataaaaataaaataaaaataagtctt

SEQ ID NO: 7268 - DNA, 1773 bp, Homo sapiens
cctatgtgcaaggcggtgagcaggggtggaaaatctcactgtgactcatccagctgatttctggaagaaacagccctcttgggtcccccaggaagggtcccaggagctgcaagcaggccaggatcagagtgagctggggttgctgccttcctgggttcctgaagtacctgaagggctgcagcagctgggctccggaaaggagatcaagggccagcaggggaggcaacggaaccggggaatcggggaggatcagcctcctgagagctgccaggagggcagacaacaggcatgaacaaagccaagtggtgggaccaggagtaactcactcaagaccatggctcagccgggcgcggtggaacacgcttgtcatcccagcactttgggaggccaaggcggaggatcacttgaggaggtgagggacattggagagaggcgggagccagaccgtgcgcagcagcagcctcagaagcccgcggtggctgcagggacacagagcctcgggaacttccggcagggcttcatgaagtgcttgctggaggtggagaaaatggaggcctcccatcggagagcctcgaaggcccggtcccagacagcccagaagtcgcccaggaccctgaccccggtgcccacctcagctccaagcctgcctcagacccctgcctcggtccctgccagcggcccatcgtgggcccggctgccagctcctgggccagaacctgcccccatgggagccccggtccccacctccatgccttgccctgtcctgctgggccctgccctggacctgggctggagaaggatggaactcttgcaccagagcagcgagagaaccctgagctacgccaaggcgcggcaggagccggaagagcagagcctccaaaagctttatcaaaaccgggagaagtccgaggagcaactgaccctgaagcaagaggaagccttccgcagctactttgagatcttcaatggtcctggtgaggtggatgcacagagcctgaagaatatcctgctcctaatgggcttctctgtgacgctggcccaggtggaggacgccctgatgagtgctgatgtcaatggagatggtcgtgtggacttcaaagacttcttggctgtgatgacagacaccaggcgcttcttctgctctgtggaacagaacgccctgtcggacatggctccccacaacccccacactctactctttgagatcctgtccctgctggtagagatgctggccttaccagaggcagtcttagaggaaatcacaaactactaccagaaaaagctgaaggaaggcacctgcaaggcccaggagatggaagcggccgtaggccggctgcggttgcagaagcttccctacaacccccagcaagaagagagctcagaagttccagaacgaaaggtcctcagtatcctgagccggctgaagcagcagaactatgctcccaacctgcagagcccctatgcccaggtgccctgcatcctgctctgcccacagctggacaagaagatggtccgtaggcagccgagcaaccactatgcactagaccagtgcacaccccctggcctggatcctgacatccgcagccccttcttccagtcaggatctcaaggaaacagggaacacaactctgacagcagaaagtggctcagctctgtgccagctcgaacccactgaccctctggaggcctgactctaggcagctgctcaaggcctgtagacagatgggccaccaggcaggagctgctgctgggatttgcttttgtggcctggtg

SEQ ID NO: 7269 - DNA, 1543 bp, Homo sapiens
ggggccgcctggacgacggttgacggaggcgagggaaactgagggcgaaagttgtgtgtcgtgttggcaggagggcctagaagggaaagactgtgcgttgataccaaactgcccccactccgtgggcgggtcaggagaggcctttggaagagcgtctcaactcggactggagcctcttctctcccaccgcggtcaggagccaaaacaggccgccatttgaggccgtggtttttgtgggtggtgtgtgtgtgtgtgcgtgcagattgagcacactttttgcacaccaatgccaccaaccccattactaacgccacttaggtccatttgggagctgggattgggggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattaggatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtgg

SEQ ID NO: 7270 - DNA, 1272 bp, Homo sapiens
gcgcggtccacggcgcctgcgaacagcctgattcccgcgctttcttcgcgggcgggaagggcggcggttgctgacggggccgcctggacgacggttgacggaggtctagtgggacaatgtcatattataaatttggaatgctgaatagaaaattatagattttgatattgaaggaaatgaagcgaagcctaaatgaaaattcagctcgaagtacagcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtgg

SEQ ID NO: 7271 - DNA, 1463 bp, Homo sapiens
aggcgagggaaactgagggcgaaagttgtgtgtcgtgttggcaggagggcctagaagggaaagactgtgcgttgataccaaactgcccccactccgtgggcgggtcaggagaggcctttggaagagcgtctcaactcggactggagcctcttctctcccaccgcggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtgg

SEQ ID NO: 7272 - DNA, 1683 bp, Homo sapiens
gtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattctttt

SEQ ID NO: 7273 - DNA, 1399 bp, Homo sapiens
cggcggttgctgacggggccgcctggacgacggttgacggaggcgagggaaactgagggcgaaagttgtgtgtcgtgttggcaggagggcctagaagggaaagactgtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 7274 - DNA, 1704 bp, Homo sapiens
aacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggcgagggaaactgagggcgaaagtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 7275 - DNA, 2335 bp, Homo sapiens
ggaagcgcgcggcgcgcggggaggcccgaactgatccgcggcggccggagaccgctggggacagacaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatggtgaccgccctgccccccgcctgccagctggtgcaggtggccctgggctgcttcgccctccggctggagtgtgagatcctgggtgaggtgctggcccagctgggcaccagtgtgctgccagctgaggagctgctgcaggcacggcgtgccagcggggacgtggcctcctgtgtggcctggctgcagcagcggctggcccaggatgaggagccgccacccctgcccccccgaggctcccctgctgcttacagggccccactggacttataccgggacttgcaggaagacgaggggtcggaggacgccagcctgtatggggagccgtcaccaggccctgactcgcccccggcggagctggcctacaggccaccactctgggagcagagtgccaaactgtggggcactgggggccgggcctgggagcccccagctgaggagctgccgcaggccagcagcccaccatatggggccttggaggaggggctggaacctgaaccttccgccttctccttcctctctctgcgccgtgagctgagtaggcctggggacctggccacccctgaaagctctgcagcggccagcccgaggcgtattcgggcagagggggtaccagcctcagcctataggtctgtctcggagcccccaggctaccaggcacacagctgcctgtcccctggcgccctgcccaccctctgctgcgacacctgtcgccagctgcatgctgcccactgtgcagccctgcccgcctgccgtccaggccactcgctgcgtgtgctgcttggcgacgcccagcggcgcttgtggctacagcgtgcacagatggacactctgctctacaacagccccggggcccggccctaggccagctgggccccaggtcaagggctcttgggagacagctcccgtggtgcttctctttgctggggaggggtctgggcctctggttgccttgtccctgggggagtcctgggcacagcagggggttggagagtccaggccaacccttgctggaggtgggactctctgtatatggaaggctccaagggcagcaggcctaagccggccagcaggagcctttccacatttccccaccctcggaacccagacgcatgcccacatgtgctgggtagaggggtccagcctgttccagccagtgcctgaacctgtccctgagaaggaccctgtgccccaaggcccgtggctcctggcctgctccctgcagtacggagtacggggctcaggacttgggggtcctccacgtgtcccagggattctccacacgagtgtcctcaagggcctgttggtgacaccgagctccccccaccccaagctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccgcccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaaccatgtctgttaaaaaa

SEQ ID NO: 7276 - DNA, 1000 bp, Homo sapiens
gactcccggcggaagcgcgcggcgcgcggggaggcccgaactgatccgcggcggccggagaccgctggggacagacaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatgctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccgcccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaacc

SEQ ID NO: 7277 - DNA, 1483 bp, Homo sapiens
atgaagaaggtcaagaagaaaaggtcagaggccagacgccaccgagactccacctcccagcatgctagctccaattccacctctcagcagcctagccctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaaggaggtgcttttaatgtgctgataaaccaacctcaggaaggtattatgtacagaagattcccaaggctgctgttgctgaaagagacttgggctactgccagggaactagggtctcactctgtcacccaggttggagtgcagcaggggcatgatcagctcactgaaggatcatttcttggtctaggctataggctggccttagaatcaactcacctggtgtcctattgtcagggacatcttaaccagggtgactgcacctcgaataaaggccagataaagccaaacttgctgggttacattccttgggggttagacacccttcatcacaagatgtttgtagctcaaagaaggggttaatgatgctaactagagacccagaacgtctgaaaacgtcctgatatttaaagaacaaagcatccttcatttgagaataagtttcactttaaagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 7278 - DNA, 1011 bp, Homo sapiens
agctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagtttgatgtccttccctgtccagagagtgaagaaccatctgacgacagtgacatctttcctttttggggaaagatgcttctagaattttctttcctaaagtttggtgaacctctcccttggcatcttcctcagctgaagatccagtttccatcaaagggacctctcttgtcaccaaaatttaaaaaaagaaaaaaaaaacga

SEQ ID NO: 7279 - DNA, 856 bp, Homo sapiens
aggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaaaaaaaaacga

SEQ ID NO: 7280 - DNA, 1618 bp, Homo sapiens
gaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaaggaggtgcttttaatgtgctgataaaccaacctcaggaaggtattatgtacagaagattcccaaggctgctgttgctgaaagagacttgggctactgccagggaactagggtctcactctgtcacccaggttggagtgcagcaggggcatgatcagctcactgaaggatcatttcttggtctaggctataggctggccttagaatcaactcacctggtgtcctattgtcagggacatcttaaccagggtgactgcacctcgaataaaggccagataaagccaaacttgctgggttacattccttgggggttagacacccttcatcacaagatgtttgtagctcaaagaaggggttaatgatgctaactagagacccagaacgtctgaaaacgtcctgatatttaaagaacaaagcatccttcatttgagaataagtttcactttaaagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 7281 - DNA, 766 bp, Homo sapiens
atgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcaggaggtgcttttaatgtgctgataaaccaacctcaggaaggtattatgtacagaagattcccaaggctgctgttgctgaaagagacttgggctactgccagggaactagaaacgtgctgagaagaggactgcaatgactgctttcaaaaa

SEQ ID NO: 7282 - DNA, 423 bp, Homo sapiens
ctgcctactacatcactgaatccttgtgaacaagcccctaggcccacagtctggcagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 7283 - DNA, 1444 bp, Homo sapiens
atagcaggagctgatggaaagaagatcgggattgttagcatttctctatccgtctagcacgccagacagggccagtctctccggctgggggcactgcgtgggcaacagcgaccgtgagggcgcgcgtctgcgctggggcctcgcgcgcgttccacgatgaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaagggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctaaca

SEQ ID NO: 7284 - DNA, 1354 bp, Homo sapiens
agttgccagttggttcgttggtccgtggaggcctctgagcacagacccgggcctcccctggggaagggggtgggaagaccccgaggtggaaaagaaggagcaccttgagctggatgggggctgcagcgagcctggttcgggctgggggcggactcgctggggctcccagggcttccaaaccacgaaacgcccaggtggagggagtaaggctcccgtttagaggccagtcctgccctcctgactttcggtggcttgtggaatttgtttgttttgactgatacctttcttacgagggactttctttgtctctgggttgcttctaatatttaaaatcatcatgggcacagatgagtccatccatgctcactggaaacagtccacggggctgccgtctcccctccatctcaagcacgacctgcggcagacagctggagaaggttccagaaaaaagggactctggcatgaccgaggtggagaggacctacagtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgaccctta

SEQ ID NO: 7285 - DNA, 1107 bp, Homo sapiens
tctgtgggagaagcaggcggctgcggtgtcccttttgccctaggctctcggttctcaggcctcggcgtgcggcgtgcgttcggcagttcagttgccagttgatgagtccatccatgctcactggaaacagtccacggggctgccgtctcccctccatctcaagcacgacctgcggcagacagctggagaaggttccagaaaaaagggactctggcatgaccgaggtggagaggacctacagtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgaccctt

SEQ ID NO: 7286 - DNA, 2151 bp, Homo sapiens
atgaaccaatcaggcacgaaccaatcaagtttatcagactcgaaccaagcaggcataaaccagccaagcacaaactcacttggtatgaaccaaatggacatgaaccaagggagtgcaagcctatatgaaatgaaccaagtggacatgaaacaaccaagcatgagccaagctggcatgaggcaatcaggtacaaacctaccagacataaaccaacccgacatgaaacaaccagacacatggcaattaggtaggagccaaccaggcatgctgcaacaagaactgagccaactagtcctgagcaaagcaggcataagccaaccagacccatcgcaaccaggcccaagccaatcaggccccagccaatcacgcatgaggcaaataggcacgaaccaatcaggtatgagccaaccagtgatgcagcaactagacagccagtcaggtgggagccaaccaagcatgagacaagtaggcaccagccaattaggcacaagccaaataggcatgagccaaccaggcacatggcaaacaggactgagccaaccagtcctgaggcaaccaaacatgagtccaccaggcatgtggcaaccaggcgtgcaacaaccaggcatcagccagcaagtcccaagccacccagacatgagtcaaccaggcatgagccagcaagtccccagccaaccaggcataaggcaaccagacactagccaatcatgtaagaaccaaacagacatgagccaaccagacgcaaaccaatcaagtttatcagattccaaccaaacaggtataatccagccaagcccaagcttacttggtatgaaccaaatggacatgaaccaatggagtgcaagcctatatgaaatgaaccaagtggacatgaaacaaccaagcatgagccaagctggcatgaggcaatcaggtacaaacctaccagacataaaccaacctggcatgaaacaaccaggcacatggcaattaggtaggagccaaccaggcatgtggccacaaagcctgagcgaactagtcctgagtgaagcaagcataagccaaccaggtccaccgcaacgagccccaagccaatcaggccccagacaatcaagcacgagccaagcaggcacaaaccaatcaggtataagccaaccagtgatgtggcaactagacatgagacagtcaggtgggagccaaccaagcatgagacaagtaggcaccagccaatcaggcacaagccaaataggcatgagccaaccaggcacatggcaaacaggcctgagccaaccagtcccgaggcaaccaaacaagagtccaccaggcatgtggcaacgaggcatgtggcaaccaggcatgagccagcaagtccccagccaactaggcatgagacaaccaggcactagccaatcaagtaagaaccaaacaggcatgagccatccaggcaggggccaaccaggcatatgggaaccggggccgagtcagccaggcctgagccaacaagacctgaaccaattagtgctgagccaaccaggcctgagtcaaccaggcaggagccaaccaagtgtgagccaaatgggcatgaggcaaacaagcatggattactttcaaataagacatgcagaggctggagactgcccagaaattttgcgactgattaaagaattggctgcctgtgaaaacatgctagatgcaatggagttaacagcagctgatttactcagagatggctttggggacaatccccttttctactgcctgattgcagaagtaaacgatcaacaaaaaccatcaggcaaactgactgttggatttgccatgtactactttacatacgactcatggactggcaaggtactttacctagaggacttttatgtcacacaagcttaccaagatagccatcacaactcaatgtaactgcatgcactttcttgtcgtcatttggaaccaggcttctatcaactactatactagtcgaggggctttagacctttcctctgaggagggctggcatctcttcaggtttaacagagaagaactcctggacatggcatgggaagaatgaaagaggctttgtaacaactcatcccaacacagcctccaacatttgactgtcacctgagtctaacagcagtttgactttgttgtacaatacagcaagtgatcatc

SEQ ID NO: 7287 - DNA, 2192 bp, Homo sapiens
atgaaccaatcaggcacgaaccaatcaagtttatcagactcgaaccaagcaggcataaaccagccaagcacaaactcacttggtatgaaccaaatggacatgaaccaagggagtgcaagcctatatgaaatgaaccaagtggacatgaaacaaccaagcatgagccaagctggcatgaggcaatcaggtacaaacctaccagacataaaccaacccgacatgaaacaaccagacacatggcaattaggtaggagccaaccaggcatgctgcaacaagaactgagccaactagtcctgagcaaagcaggcataagccaaccagacccatcgcaaccaggcccaagccaatcaggccccagccaatcacgcatgaggcaaataggcacgaaccaatcaggtatgagccaaccagtgatgcagcaactagacagccagtcaggtgggagccaaccaagcatgagacaagtaggcaccagccaattaggcacaagccaaataggcatgagccaaccaggcacatggcaaacaggactgagccaaccagtcctgaggcaaccaaacatgagtccaccaggcatgtggcaaccaggcgtgcaacaaccaggcatcagccagcaagtcccaagccacccagacatgagtcaaccaggcatgagccagcaagtccccagccaaccaggcataaggcaaccagacactagccaatcatgtaagaaccaaacagacatgagccaaccagacgcaaaccaatcaagtttatcagattccaaccaaacaggtataatccagccaagcccaagcttacttggtatgaaccaaatggacatgaaccaatggagtgcaagcctatatgaaatgaaccaagtggacatgaaacaaccaagcatgagccaagctggcatgaggcaatcaggtacaaacctaccagacataaaccaacctggcatgaaacaaccaggcacatggcaattaggtaggagccaaccaggcatgtggccacaaagcctgagcgaactagtcctgagtgaagcaagcataagccaaccaggtccaccgcaacgagccccaagccaatcaggccccagacaatcaagcacgagccaagcaggcacaaaccaatcaggtataagccaaccagtgatgtggcaactagacatgagacagtcaggtgggagccaaccaagcatgagacaagtaggcaccagccaatcaggcacaagccaaataggcatgagccaaccaggcacatggcaaacaggcctgagccaaccagtcccgaggcaaccaaacaagagtccaccaggcatgtggcaacgaggcatgtggcaaccaggcatgagccagcaagtccccagccaactaggcatgagacaaccaggcactagccaatcaagtaagaaccaaacaggcatgagccatccaggcaggggccaaccaggcatatgggaaccggggccgagtcagccaggcctgagccaacaagacctgaaccaattagtgctgagccaaccaggcctgagtcaaccaggcaggagccaaccaagtgtgagccaaatgggcatgaggcaaacaagcatggattactttcaaataagacatgcagaggctggagactgcccagaaattttgcgactgattaaagaattggctgcctgtgaaaacatgctagatgcaatggagttaacagcagctgatttactcagagatggctttggggacaatccccttttctactgcctgattgcagaagtaaacgatcaacaaaaaccatcaggcaaactgactgttggatttgccatgtactactttacatacgactcatggactggcaaggtactttacctagaggacttttatgtcacacaagcttaccaaggcctaggtattggagctgaaatgctgaagaggctaagtcagatagccatcacaactcaatgtaactgcatgcactttcttgtcgtcatttggaaccaggcttctatcaactactatactagtcgaggggctttagacctttcctctgaggagggctggcatctcttcaggtttaacagagaagaactcctggacatggcatgggaagaatgaaagaggctttgtaacaactcatcccaacacagcctccaacatttgactgtcacctgagtctaacagcagtttgactttgttgtacaatacagcaagtgatcatc

SEQ ID NO: 7288 - DNA, 2224 bp, Homo sapiens
cagccatcagccaatcagttgtctgccaacccatcatctgccaccccatccttagtcaacaaagcaggaatcaactgggcatgaaccaatcaggcacgaaccaatcaagtttatcagactcgaaccaagcaggcataaaccagccaagcacaaactcacttggtatgaaccaaatggacatgaaccaagggagtgcaagcctatatgaaatgaaccaagtggacatgaaacaaccaagcatgagccaagctggcatgaggcaatcaggtacaaacctaccagacataaaccaacccgacatgaaacaaccagacacatggcaattaggtaggagccaaccaggcatgctgcaacaagaactgagccaactagtcctgagcaaagcaggcataagccaaccagacccatcgcaaccaggcccaagccaatcaggccccagccaatcacgcatgaggcaaataggcacgaaccaatcaggtatgagccaaccagtgatgcagcaactagacagccagtcaggtgggagccaaccaagcatgagacaagtaggcaccagccaattaggcacaagccaaataggcatgagccaaccaggcacatggcaaacaggactgagccaaccagtcctgaggcaaccaaacatgagtccaccaggcatgtggcaaccaggcgtgcaacaaccaggcatcagccagcaagtcccaagccacccagacatgagtcaaccaggcatgagccagcaagtccccagccaaccaggcataaggcaaccagacactagccaatcatgtaagaaccaaacagacatgagccaaccagacgcaaaccaatcaagtttatcagattccaaccaaacaggtataatccagccaagcccaagcttacttggtatgaaccaaatggacatgaaccaatggagtgcaagcctatatgaaatgaaccaagtggacatgaaacaaccaagcatgagccaagctggcatgaggcaatcaggtacaaacctaccagacataaaccaacctggcatgaaacaaccaggcacatggcaattaggtaggagccaaccaggcatgtggccacaaagcctgagcgaactagtcctgagtgaagcaagcataagccaaccaggtccaccgcaacgagccccaagccaatcaggccccagacaatcaagcacgagccaagcaggcacaaaccaatcaggtataagccaaccagtgatgtggcaactagacatgagacagtcaggtgggagccaaccaagcatgagacaagtaggcaccagccaatcaggcacaagccaaataggcatgagccaaccaggcacatggcaaacaggcctgagccaaccagtcccgaggcaaccaaacaagagtccaccaggcatgtggcaacgaggcatgtggcaaccaggcatgagccagcaagtccccagccaactaggcatgagacaaccaggcactagccaatcaagtaagaaccaaacaggcatgagccatccaggcaggggccaaccaggcatatgggaaccggggccgagtcagccaggcctgagccaacaagacctgaaccaattagtgctgagccaaccaggcctgagtcaaccaggcaggagccaaccaagtgtgagccaaatgggcatgaggcaaacaagcatggattactttcaaataagacatgcagaggctggagactgcccagaaattttgcgactgattaaagaattggctgcctgtgaaaacatgctagatgcaatggagttaacagcagctgatttactcagagatggctttggggacaatccccttttctactgcctgattgcagaagtaaacgatcaacaaaaaccatcaggcaaactgactgttggatttgccatgtactactttacatacgactcatggactggcaaggtactttacctagaggacttttatgtcacacaagcttaccaagatagccatcacaactcaatgtaactgcatgcactttcttgtcgtcatttggaaccaggcttctatcaactactatactagtcgaggggctttagacctttcctctgaggagggctggcatctcttcaggtttaacagagaagaactcctggacatggcatgggaagaatgaaagaggctttgtaacaactcatcccaacacagcctccaacatttgactgtcacctgagtctaacagcagtttgactttgttgtacaatacagcaagt

SEQ ID NO: 7289 - DNA, 1120 bp, Homo sapiens
aaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaacc

SEQ ID NO: 7290 - DNA, 1173 bp, Homo sapiens
cggccgccctggggacgcagacgccaaggcccctccggccagggccgggagccgggccggcctagccagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggaggccgggggtgggggtgcaaggacggaggcggggcgggaccccgggccaccacctcctgccactccgcagctccagctccctggagaggggcatgcacatgcccacgtcacccacgtttctggagggcaacacggtggtctga

SEQ ID NO: 7291 - DNA, 3791 bp, Homo sapiens
ggcaaacagcccgcccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagatccttttgtcatgtctgaaatcactcttgagaggtctggggtggaggatggggagtcagtgaaatgtgtcatgtctgggccctgtcagggacacccttgttatatctgggatcctccaatcacatctgagacctcctaggctctccatctgatatgccctttcagggaccccacaaagactgagttctcatggggatcctacccttcctagtgccactccctatggccatgctgaagaccactctggccacgcgactgattttgggtgatcatggcagctccccacccatgtcatttctaaccagaagtctcaaggtcgtcacccccctgccccccaaccgaggccccggtcgctggtggtggtctctttagtgcactgtagcacttggtggtggaggtgtgagggatccacattaacagcaggccatcagctgggcaatggctcacacctgtaatcccagcactttgggaggcgaggcagggggaatggcttgaacccaggcattcaagaccagcctgggcaacataatgagacctcgtctctacaaaacataacaaaaacaattagccgagcgtgggggtgaacacctgtggtcccagctgctcaggaggctgaggtgggaggatctcttgagcccaggaagtaggaggctgtagtgagctgtaatcgtgccactgcactccagcctgggcgacagagtgagacaccgtcttaaaaacaaaaacaaggccgggcacggtggctcatgcctgttgtcccagcactttgggaggccgaggcaggcggatcacgaggtcgagagatcgagaccatcctggccaacatggtgaaaccctgtctctactaaaaatacagaaattagctgggcgtggtggcacgtgcctgtagtcccagctactcgggaggctgaggcaagagaatcgcttgaacgtgggaggcagaggttgcagtgagcctagattgtgccactgcactccagcctgggggacagagcgagactccgtctgaaaataaaaacaacaaaaacagcagaccattcaaaatagggagactttgcataatccagatttctgccttcacttaaaactttggacggtctggagagagtcggccagttttcggtggggggtggggagctggaacaggacagtagcctttcctaatgaggcatttgttctccaatctgccccagtcgctgccatccctggctatctcaccctagcagcttctcaagcctgttggctttagaccactgtataaacccagctggaactgaagcctgggtggactatggagccctggttgggacccccagggagtcaaaggctgcgggccaagaggccagaggtccttgagcctgggtgggcaggtggatctagggtgcatgacttgctgcttcccaaccttagtttgtcccttctgtgaaaaagggagagaaggaggaggaagatctcaaaaagactttccagcccagtgcggtggctcacgcctgtaatcccagcactttgggaggccgatgcaggtggatcacctgaggtaggagttcaagaccagcctgaccaacatagtgaagccccttctctactaaaaatacaaaattagctgggcgtggtggcatgtgcctgtactcccagctacttgggaggctgaggcaggagaatcgcttgaacctgggaggcggaggttgtagtgagctgagatcacaccactgcacaccagcctgggcgacaagagcgaaactccgtctcaaaaaaaaaaaactgttgcagccccgttgagcctttgacaccgcctgaaatccaccccactcccaggaggaggaggaggaaggaatgccaatgacctagagacacgagaagtccatgtggaggcacacagcagctgatggcagagcccaggctgggacctgcccttaagagaatgagtgggaagggggagggaggaagggcaggtaaaacgtcctccccagggccccctgcaacggggaaggtactttttacaaaagctatcattgtcaccctaaatgtggaataaaataagatgcatcgacgtagacaaacctcctgggaccttttgtcagggactgcaatcctgcccctccactgaggccgctggctctcagagacaccgtgacatcacgggtgatgatgagaggagttcaaagagagaattatatgctggcgcggtggctctgtaatcccaacactttggggggccaaggcaggaggatcgcttgagtacaggagtttgaaaccagcctgggcaagatagtgagatccccttcccacccgtctacaaaaaaaataaaaaattagcggg

SEQ ID NO: 7292 - DNA, 2905 bp, Homo sapiens
gatgacgcaaaccgggaacagcggctgagcctgcgcttcggaagcatggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttttgagacagtctcgctctttcacccaggccggactgcagcggcgctatctcggctcactgcaaactctgcctcccaggttcacgccatcctcctgcctcagcctcctgagtagctgggactacaggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaagtaaa

SEQ ID NO: 7293 - DNA, 826 bp, Homo sapiens
gtcggaggaatgtcaactattaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcaatatcaaactttgtatgcccgctttaaaccagttgctgttgagcagaaagagactaagagccgcatttgtgctggtatgactaaaactatgaatgtgatacaaaaactacagaagcaaacagacctggatctgtcaccactgactaaagaagagaaaactgcggcagagcaattcaaatctcacgtgccagatttatgaagaaatggacttggaaaggaaattctaacagagaagagcttaattccagagaaatttaggaagatgtcttgttaacccttgatgtctagagattgggggctggtgaaggaagtttggcttcaatgactggataatgatgtctttcatgagagagactataagaagaagggcagataatatatgaataaagttcagccaaaaggattaaatgagaataaaatgatttaaatatatgtacacacgcatgtacacacatacttagtcttgtaatttcaggccagaaaatctcttaacactattttgcatgtgttttctttttctaaatcatgataatgtagaggttctggtctatcataaaagaatgtttatgtacatttcagtcattcggtatgtggccttgtaaattaaagtataggcaaaacaaaaaaaagaagaa

SEQ ID NO: 7294 - DNA, 1319 bp, Homo sapiens
ggagcccaggaggggccccaagaaaagaaaggcagatctgctctgtgattagaatggaagacatcactactaagaggaaactaacactgtagtcttgtgcagaaaaagggcagagactacagccactgcatcagggactggtggcagcccaacgtggctgaggggtggccgccaccaacagggaggtagacggccagcgagcgaagcgctggggacaccgctgcagtgctctttgcctgtctcgccgcgctcctacacacgctcctcatctatggatcctaccctccccgctcttgcaagcagtcactcagcgagtcgcctgttgaccctccttcgccacaggctcacagcagaggcagcatcgagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatga

SEQ ID NO: 7295 - DNA, 2468 bp, Homo sapiens
ggcagtgggggttacagacagcaccagaggcactcagggcaggagggtagtgggtgctggtcaaggccgctttgcaggggattgggagtggatgctagtggcagtaaagggtaaagggagggcagtgggctctgagctaggaggaggtggcccagccacttctgcagagttcctaaccccagacagctctactgcaccaccccagcccttccccacagcccaaaggaacttaagagggagagcactgcgggcatgcagccaggatttccagcattgcttccaggctcctaggggaaacttaggcactagcgcagactacatccagacatggctatagggaaaagtttgccttgtggcacactgggtgtgtctctctatcctctctcctcccccagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatgacatgctgtctgtaagccctttgtcttgttgaaaagttcgggtgtgtttggtagatggggcatggaaggaacgaacagctgtcaatttcggctgtgaataaagttcagctagaatcataatcagtcatttaaaaatggcactggatttagctggtctggtctggagggggcaggggaaggaacaagagattggctgtcttggggagagaggaggaggtgactgcttaggaagaggtggaaaagggccagaaagggaggggctccttgggggaggggatgacctatgagaaggaaacatccaactcagaaggaagactaacagagggagagtgagatcttggggcttagaggaaaatagaataaactgagtagagaggaacacaaagaagcttagaagagggtccagagtaaggtggagaaggatcaacctgacagggatctgggagaggctaaaggatacacaaaggaagaggctatgtgggttagggtgttggagggattagaagagggccactgaggaaggaggaattcaaagaagaaagactgacagagggagtgagaatacaggaaaagagttgtggggtatggggcccatgagagatcggaaggcccaggaaaatgttggacttctggtagtgtccacattgctcttcctggctctatgcacaaaggaagtggcaactgtcaaagatgccagatgcattggaggttcactagaagagcatgttgacaggaatgactcagtcaagttaatcaggagccaagtttatgcccataaggcttttcctgtttcagggagttaatgacacacttgtccagcagaaacccaatgctcagcctaaacacgctaacatggtgccccacatgtgctgggctgtgggctgcctcctcacatttgtcctgcgctagataagcaatcttggtagaggatgggttagtggggctctcagaacttaagagatgtgccatcttgcatttggaaagtactttatccagaaaaaatgaaatcttactgaactcaggtacagcagtctcatcactcctattccttctgctggaatgtttgttttctatctagagatgaggggcatcagaggactgagcctagtgtttctctcgag

SEQ ID NO: 7296 - DNA, 573 bp, Homo sapiens
agaaaaagaaggaggagactgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggtggggaatctgcgcctcctggccgggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcagctctta

SEQ ID NO: 7297 - DNA, 1100 bp, Homo sapiens
tgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggtggggaatctgcgcctcctggccgggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcaggtacctgtaaatccctctctgtatcttatcaaatatgatggatttgactgtgtttatggattggaacttcacagagatgaaagagtgtcatcacttgaagtccttcctaatagagttgcatcatctagaatcagtgatacacacttggcagaaataatggttggcaaagcagtggaacatatttttgagacagaggaaggttccaaaaatgaatggagggggatggtcttagctcaggcacctgtcatgaacacatggttttacattacctatgagaaagatcctgtattatatatgtaccagctcttagatgattataaagatggtgacctccgcatccttcaagattccaatgattctcctctggcagagagggagccaggagaagtcatagacagcctggtaggcaaacaggtggaatacgccaaagacgatggctccaagagaactggcatggtcattcatcaggtagaagcaaaaccctctgtgtacttcatcaaatttgatgatgatttccatatctatgtctacgatttggtaaaaacatcttag

SEQ ID NO: 7298 - DNA, 4112 bp, Homo sapiens
ggtcgccagagtgaagccaagccagctagcgctgcgaagcccaggccgcgcggactccccagagacttgccgccgcctgcgcctttgccgctgcagccatccctcttactccttgcctttcgtccccgtcgtctcctctgccgccgtgccgcagccgcaccagcatcgacaacagctaagtggccgattcggggacttggggtcggggttggggcggacgcaaggcacgaacagcactcgcgagcccgccatctctacgtcagccgccactgctgcagtaacccttctagggcgagagaggaaagcactgtggagaggcacacgctgtcccagtgctcacggttagagttcgagcgtttctgccaaaaccttggtgagagccttgcacttggagaagggagcacagaccaggtctttgagatcgcaaaaaatatatatatcatattgcatagtgttgactttttgtcagtttaatcgaccagggcagcagctttccccaagccctcttaatccctgagctatgtctcctccaaccgtgcctccgatgggggtagatggcgtgtccgcatacctgatgaagaaaaggcacacccacaggaagcaacggcgcaagcccactttcctcactcgtaggaacatcgtgggctgccgcattcaacacggctggaaggaaggcaacgagccagtggagcagtggaagggtactgtgctcgagcaggtttccgtgaagcccactctttacatcattaaatatgatggcaaagatagtgtgtatggactagaactgcaccgcgataagagagttttagcgctagagatccttcctgagagagtgccaactcctcgtatcgattcacgactggcagattccctgattggcaaggcagtggagcatgtgtttgaaggtgaacatggtaccaaggatgaatggaagggtatggtcctggcgcgagctcctgtgatggatacttggttttacatcacctacgagaaagatcctgttctctatatgtacacgctgcttgatgactacaaagatggtgacttacgcattattccagattccaactactatttccctacagcagaacaggagcctggagaggtggtcgacagtctcgtgggcaagcaggtggagcatgccaaagatgacgggtccaagagaactggcatttttatacatcaagtggtggcgaagccatctgtttacttcattaagtttgatgatgatattcacatttatgtctatggtttggtgaaaactccttaaattctttgtgctctttagagaagttgtggatctgttagatgtgaattattttgtgttctcgtagttgtgaacgcagagaagagtttaggtgtcagaaattcaggaaagtggataaattttattgtgccaacaaatcttaccttgactagtttcacaattttgcctcaagtgtactttgctacttttgatattgccttgttctgtaacttaacagttaaattgggtgctaatagaaaattaaaaagtgtttgcaaccattggaacaatgcaaaaatagattaagaaaaattaatggtgtaaacccacaccccgtccttaccccttcctttccttaccttgtttcttcccagaaaacaagtgttgaggatgcgaagtacatccttccacctattttccccatcttcatgcagaaagtatgttctagtagtttctgtaaaaatggcaagccacatgcttttctcacttgacatgtagatgatatctcttcttatcagtagcttcagtctttcttgctctctctggctctctctggccctcactcttactctcttgcactcttgctctccccctccctcccttactctaacagctgaatacacagtacttgttgatgtaccaaaaaggcattcaaccatttcgttattgatcgtcttttatttcctttttttattttttttcaaaataacactgctgtaatacatactggtgcttttatttatataggttggattcccagaaatactatgtaggcatatgtttcagaaatattacaagattactatccaaaatgaaagcgcccgttccagcgtcctctccagcactctttaatgcttgaaaatatgaaaggctaaaaattgcattgtattgcttgttagtttaattgccttttgtctgagttcaaagaggtttgttgttgttgctgtccttgtttctgtttggatttttctctgatttgcctgttcttaccctttgctcatgtatctattgatgtttttcattataaatttgtagaaattcttactacatagtgcatattaatcatttgtagctctaatgtgttatgacgttttcatcttgactttattgatgatatattttcctttaaaatttttaaactttttaggtagacccttatctcttttatagattttggtttcctttttttatcacatggatgcccccacccaaagtcatacaaatattcacctacattttcttctaataactttattatttttaatgtttaaatgtttgatccatctgaaatttatttttgtatatggtgtaagatggggatccagctataacattttgttcacattggatacctgattgtgacatttatttaaaatgttacccattttcaaatttctgagccaatatcatgatttaattatagtggcttcatcgtaagttttagaatccgataaagcaagtcccacttcattagttttttttttctttatataatatgtcctagacattcattttttcatgtgaaaaaatgaaatgcagaattttaataaaattctaattatgatggctgacatcacaattaaaatcctgcatttttgtttagagggctctttaataatattaaatcttagcactcaagagtcttcgtacatcattgaaatcttttggtcttgttattggaatattcttcacgtaagtatatcatagctaactgaatttatttctaagtatttttacagttttatttcatattttgacattgtgaattggtttttttcttctcatttgtaattagctatttttgacaatatagacaacctatagatttttgtatttttatcttctgtctaatgagcttatttaatcattgaaattacagtagatttttaagaatataatattttgggttttctagatatgaaattatttcacctgaacatatagatcattttatttcctcttaatgtttatactgattactgttacattagctggatttttcaaaacaatgttgaagagtgatgacagacgtgactgtcttgttcttaattttcatggaagtaagaatgcaaaatattaatagggaatagtattccctattagtatgacatttacttttggttattagtaggtagtcattaacatgtttaagagtttccgctattcctgttttatagtgttattgctagaagtggttcctgaattttataaaatgccttttcagcatctattgataaaattgtatgattttttttctctttaatttgttgatgtaatgaattagaatggtaggcatttgatgtggaaccaaacttgtatttctggaacaaatactacttggtcattgtgaaataatgatttgctacatgagtggattttatttaccagtatttaatttagaattattgcattttcattccaaagtaaaattgtattttgtccttctgatgctatctttatcaagttttgttattgaagttgtgctagctttaaaaaaatatgaatatgtgagttttcaatttttttcctgtggtctggaataatttaaatagcattagaattatttgtttgttaaaagttagctaggacaaagtgtaaaacaatctaatcctgatgacacttttaatagtagatttttaatcagctttgtgatttctttaatagttattggtttattcaggctttttattaaaaaggtatatacattctctgtgacatacaaagttaaaagttctctattattgctgattgtactggttgttgcttgttgactgtactattcagatggctttatgcttttgtgtattttatgtcacctagatctaattctgaaaacattgtaataaaataattagctataatggta

SEQ ID NO: 7299 - DNA, 4117 bp, Homo sapiens
gacccggtcgccagagtgaagccaagccagctagcgctgcgaagcccaggccgcgcggactccccagagacttgccgccgcctgcgcctttgccgctgcagccatccctcttactccttgcctttcgtccccgtcgtctcctctgccgccgtgccgcagccgcaccagcatcgacaacagctaagtggccgattcggggacttggggtcggggttggggcggacgcaaggcacgaacagcactcgcgagcccgccatctctacgtcagccgccactgctgcagtaacccttctagggcgagagaggaaagcactgtggagaggcacacgctgtcccagtgctcacggttagagttcgagcgtttctgccaaaaccttggtgagagccttgcacttggagaagggagcacagaccaggtctttgagatcgcaaaaaatatatatatcatattgcatagtgttgactttttgtcagtttaatcgaccagggcagcagctttccccaagccctcttaatccctgagctatgtctcctccaaccgtgcctccgatgggggtagatggcgtgtccgcatacctgatgaagaaaaggcacacccacaggaagcaacggcgcaagcccactttcctcactcgtaggaacatcgtgggctgccgcattcaacacggctggaaggaaggcaacgagccagtggagcagtggaagggtactgtgctcgagcaggtttccgtgaagcccactctttacatcattaaatatgatggcaaagatagtgtgtatggactagaactgcaccgcgataagagagttttagcgctagagatccttcctgagagagtgccaactcctcgtatcgattcacgactggcagattccctgattggcaaggcagtggagcatgtgtttgaaggtgaacatggtaccaaggatgaatggaagggtatggtcctggcgcgagctcctgtgatggatacttggttttacatcacctacgagaaagatcctgttctctatatgtacacgctgcttgatgactacaaagatggtgacttacgcattattccagattccaactactatttccctacagcagaacaggagcctggagaggtggtcgacagtctcgtgggcaagcaggtggagcatgccaaagatgacgggtccaagagaactggcatttttatacatcaagtggtggcgaagccatctgtttacttcattaagtttgatgatgatattcacatttatgtctatggtttggtgaaaactccttaaattctttgtgctctttagagaagttgtggatctgttagatgtgaattattttgtgttctcgtagttgtgaacgcagagaagagtttaggtgtcagaaattcaggaaagtggataaattttattgtgccaacaaatcttaccttgactagtttcacaattttgcctcaagtgtactttgctacttttgatattgccttgttctgtaacttaacagttaaattgggtgctaatagaaaattaaaaagtgtttgcaaccattggaacaatgcaaaaatagattaagaaaaattaatggtgtaaacccacaccccgtccttaccccttcctttccttaccttgtttcttcccagaaaacaagtgttgaggatgcgaagtacatccttccacctattttccccatcttcatgcagaaagtatgttctagtagtttctgtaaaaatggcaagccacatgcttttctcacttgacatgtagatgatatctcttcttatcagtagcttcagtctttcttgctctctctggctctctctggccctcactcttactctcttgcactcttgctctccccctccctcccttactctaacagctgaatacacagtacttgttgatgtaccaaaaaggcattcaaccatttcgttattgatcgtcttttatttcctttttttattttttttcaaaataacactgctgtaatacatactggtgcttttatttatataggttggattcccagaaatactatgtaggcatatgtttcagaaatattacaagattactatccaaaatgaaagcgcccgttccagcgtcctctccagcactctttaatgcttgaaaatatgaaaggctaaaaattgcattgtattgcttgttagtttaattgccttttgtctgagttcaaagaggtttgttgttgttgctgtccttgtttctgtttggatttttctctgatttgcctgttcttaccctttgctcatgtatctattgatgtttttcattataaatttgtagaaattcttactacatagtgcatattaatcatttgtagctctaatgtgttatgacgttttcatcttgactttattgatgatatattttcctttaaaatttttaaactttttaggtagacccttatctcttttatagattttggtttcctttttttatcacatggatgcccccacccaaagtcatacaaatattcacctacattttcttctaataactttattatttttaatgtttaaatgtttgatccatctgaaatttatttttgtatatggtgtaagatggggatccagctataacattttgttcacattggatacctgattgtgacatttatttaaaatgttacccattttcaaatttctgagccaatatcatgatttaattatagtggcttcatcgtaagttttagaatccgataaagcaagtcccacttcattagttttttttttctttatataatatgtcctagacattcattttttcatgtgaaaaaatgaaatgcagaattttaataaaattctaattatgatggctgacatcacaattaaaatcctgcatttttgtttagagggctctttaataatattaaatcttagcactcaagagtcttcgtacatcattgaaatcttttggtcttgttattggaatattcttcacgtaagtatatcatagctaactgaatttatttctaagtatttttacagttttatttcatattttgacattgtgaattggtttttttcttctcatttgtaattagctatttttgacaatatagacaacctatagatttttgtatttttatcttctgtctaatgagcttatttaatcattgaaattacagtagatttttaagaatataatattttgggttttctagatatgaaattatttcacctgaacatatagatcattttatttcctcttaatgtttatactgattactgttacattagctggatttttcaaaacaatgttgaagagtgatgacagacgtgactgtcttgttcttaattttcatggaagtaagaatgcaaaatattaatagggaatagtattccctattagtatgacatttacttttggttattagtaggtagtcattaacatgtttaagagtttccgctattcctgttttatagtgttattgctagaagtggttcctgaattttataaaatgccttttcagcatctattgataaaattgtatgattttttttctctttaatttgttgatgtaatgaattagaatggtaggcatttgatgtggaaccaaacttgtatttctggaacaaatactacttggtcattgtgaaataatgatttgctacatgagtggattttatttaccagtatttaatttagaattattgcattttcattccaaagtaaaattgtattttgtccttctgatgctatctttatcaagttttgttattgaagttgtgctagctttaaaaaaatatgaatatgtgagttttcaatttttttcctgtggtctggaataatttaaatagcattagaattatttgtttgttaaaagttagctaggacaaagtgtaaaacaatctaatcctgatgacacttttaatagtagatttttaatcagctttgtgatttctttaatagttattggtttattcaggctttttattaaaaaggtatatacattctctgtgacatacaaagttaaaagttctctattattgctgattgtactggttgttgcttgttgactgtactattcagatggctttatgcttttgtgtattttatgtcacctagatctaattctgaaaacattgtaataaaataattagctataatggta

SEQ ID NO: 7300 - DNA, 1236 bp, Homo sapiens
ggccggcggtctgcgccctgcgcgcctcggcttctttccgcccggctccttcagaggcccggcgacctccagggctgggaagtcaaccgagctcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttatagaaa

SEQ ID NO: 7301 - DNA, 1205 bp, Homo sapiens
cagaggcccggcgacctccagggctgggaagtcaaccgaggttcgggggcagcggcgagggctccgggcgagtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttatagaaa

SEQ ID NO: 7302 - DNA, 4757 bp, Homo sapiens
gcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactac

SEQ ID NO: 7303 - DNA, 2644 bp, Homo sapiens
cctctaggagtgaaggaaaggcggggacccggatgtgtgtggtggcggcggccgaagagcttgtgtgcggagctgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagctgtacaatggccgagccaagggccgccagtttgggtcaaagtgcaactccggggaccggattggctgtggcattgagcctgtgtcctttgatgtgcagaccgcccagatcttcttcaccaaaaatgggaagcgggtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgttcccccgggactacattttggacagtgagggggacagtgatgacagttgtgacacagtgatcctgtctccgactgcccgggccgtccggaacgtgcggaatgtcatgtacctgcaccaggaaggggaagaggaagaggaggaagaggaagaggaagaggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctcaggcccctgtcacgcttctctgtgcccacgtttctgacctggtgctgccactgttgtcagtccctgggcctgagtccctggttggacaggaatggacccaaagaatggtgttggtatgtgggtggtcccactcgctttggtcagtgggcttctgggtccccctttccctcaccggccctgtgtgggtggagaggcgtgagcaccctatctcagctgctattcgggcatgatgctttgtagagggtagagtagacagccccctcccctactcaccatggtatttctccttgaattcctctttcttgttttctttcctggttgtgtgaaccagttgctgctgtcatacccctggcagggccaggggacctctctttggtcatctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatctccttctaatccttcaacccctggccccctccccgtaacagtgacttttccagggaggaagaggcagcaggagctgttggccttggtttgcacagagcgggtagggctgtagggaaagcgggtgagctgttgtgctgctgggcctccctttggccctcgcttcccaccctacgatgtatgaaatgtatgtacagaccagagatgtttatacagccgataaagatggagtttccgta

SEQ ID NO: 7304 - DNA, 1629 bp, Homo sapiens
gcagggaatgagctcctgatcttggggagtacttaaaagaattttttcttggaagaattactgcaggaaacattcatagaaccttgggaaacatgaattctggaatcttgcaagtcttccagagggcactcacctgtcccatctgcatgaactacttcctagacccagtcaccatagactgtgggcacagcttttgccggccctgtttgtacctcaactggcaagacacggcagttcttgctcagtgctctgaatgcaagaagacaacgcggcagagaaacctcaacactgacatttgtttgaagaacatggctttcattgccagaaaagccagcctccggcaattccttagctctgaggagcaaatatgtgggatgcacagagagacaaagaagatgttctgtgaagtggacaagagcctgctctgtttgccgtgctccaactctcaggagcaccggaatcacatacactgtcccattgagtgggctgctgaggaacgccgggaggagctcctaaaaaaaatgcagtctttatgggaaaaagcttgtgaaaatctcagaaatctgaacatggaaaccacaagaaccagatgctggaaggattatgtgagtttaaggatagaagcaatcagagctgaatatcagaagatgcctgcatttctccatgaagaagagcaacatcacttggaaaggctgcgaaaggagggcgaggacatttttcagcaactcaatgaaagcaaagccagaatggaacattccagggagcttttaagaggaatgtatgaggatctgaagcaaatgtgccataaagcagatgtggagctactccaggcttttggagacatattacacaggtatgagtctctgctgctgcaagtgtctgagcctgtgaatccagagctcagtgcagggcccatcactggactgctggacagcctcagtggattcagagttgattttactctgcagcctgaaagagccaatagtcatatcttcctgtgtggagatttgagaagcatgaatgttggatgtgaccctcaagatgatcccgatatcactggaaaatctgaatgttttcttgtatggggggctcaggctttcacatctggcaaatattattgggaggttcatatgggggactcttggaattgggcttttggtgtctgtaacaattattggaaagagaagagacagaatgacaagatagatggagaggagggactctttcttcttggatgtgttaaggaggacactcactgcagtctctttaccacctccccacttgtggtgcaatatgttccaagacctaccagcacagtaggattattcctggattgtgaaggtagaaccgtgagctttgttgatgttgatcaaagttccctgatatacaccatccccaattgctccttctcacctcctctcaggcctatcttttgctgtagtcacttctgaccagagaaaagtcagaaatgtgcctgtatgctctgggaacctgtttatcccagaaagccctctttttcgcacctcatcaaacagaacaaataagttatatttaatgtctttagttgcattctaatgtcatcaaaactcatttatagtgtttctattaaatatggtgaaaacattaaaa

SEQ ID NO: 7305 - DNA, 3053 bp, Homo sapiens
atagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacatatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatc

SEQ ID NO: 7306 - DNA, 3086 bp, Homo sapiens
ccgtctccccggcccagcccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacatatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatc

SEQ ID NO: 7307 - DNA, 1275 bp, Homo sapiens
ggactcgcgagcgctgtggcggccctgaaaggatataggccgtggagggaagggggcgggcagacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaaaacatgtttggaaagagaataaatatatgaagagagactggttgttttattttcaatgtattgaatatattagactactatttattttctga

SEQ ID NO: 7308 - DNA, 5754 bp, Homo sapiens
taaaagcggaagttacgcagggactcgcgagcgctgtggcggccctgaaaggatataggccgtggagggaagggggcgggcagacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaagtgtcccaaagacttctgctagcaggactcagaaatctgctgttgagcacaaagccaaaaaatctctgtcccatcctagccattccaggcctgggcccatggtcaccccacacaataaggctaagagtccaggtgtcaggcagccaggcagcagctctagctcagcccctgggcagcccagcacaggggttgctcgacccacagttagttctggccctgtgcctaggcgccagaatggcagctccagctcaggacctgagcgatcaatcagtgggtccaagaagccaaccaatgactcaaatccctctaggcggacagtcagtggtacatgtggccctggacaacctgcaagcagctcaggtggccctgggcgacccatcagtggttcagttagttctgcaagacccttgggcagctctcgtggccctggccggcctgtgagcagtccacatgaacttcgacgaccagtgagtggcttgggccccccggggcggtctgtcagtggccctgggagatccataagtggctcaattccagctggacggactgtcagtaattcagtcccaggaagaccagtgagcagcttgggacctgggcaaacagttagtagctcaggtcccactataaagcctaagtgcactgttgtctccgaaacaatttcttccaagaatatcattagccggtccagcaatggacagatgaatggaatgaagcctcccctatctggctacagagctgcccaaggtcctcaaaggcttcccttccctactggttacaaaaggcagcgagaatatgaagaggaagatgacgatgatgatgaatacgactctgaaatggaagattttattgaagatgaaggagagcctcaggaagaaatatccaagcacattagagaaatctttggttatgaccgaaaaaaatacaaagatgaaagtgattatgccttacgttacatggaaagtagttggaaagagcagcagaaggaagaagcaaagagcttaagactgggtatgcaagaggacttagaggaaatgagacgtgaagaagaagaaatgcaacgtcgaagggccaagaagctgaagaggcgttagctgctgcttttatttttgtgaaattctagagctgctctgctgcaaggatttcctgccttcagactgaagaagcccccttatcattttagatttatacttgggtactcaaggagaaggaatgcatactgtcatttgcaggctgtcatttgagcataaaatattttcagatattttccagggtgaaatctgtaatgcagatgatataatgcccacttgtgctcttatgaagttaactgttcacagatgccagccttgatcctgatgagctatgcactctaatgtggggccactcaccagtcagccaatcttttattgttcctttgctactttgaaaggaaaaaaaaggttgtctcttgatttctgtaattcttctgctgatctgtgagtagggcactgccctgctcccaatcaaacttagtctttttatgagaaacctggaccttccatgaatgttgccagcaataaagtgacttgtcctaatctatggattgagaacttgaaaatgtagagtagaatttataactatcatatggatgtcatcctgtgactttgaagtacaaagtagaataaattctgtattcatggattggatgctgagcattcttactcattaatttaggtggctaggaattaatgaaaaaattttcaagttaaaatacaggttataacagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgttttggctatcttaagccattgtatgggggggattaggaagtaggagggattgtcctacaacaggcccttatacttcaacagcccaaatattttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaagtagttttcataaaactcatggctctgattgcacagtcccacttgcttttgatattgctatgtcaaagcaaagggcacttcttttaaggctactttcagaactttgtattttcgctaaactataaatgcagttgtgtccagttggaggccagggtaccacatgtcacaggcggccttacatgtgtgccgtgaaaaggttcaaagaccgttaacaaaaaagtaagtctggccgggcatggtggctcaagcctgtaatcccagcactttgggaggccgaggcgggcggatcacttgagaccaggagttcgagaccagcctggccaacatggtgtgagaccccgtctctactaaaaataaaaaaattagccgggtgcggtggcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaagaatgtgggaactcaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagactactatttattttctgagtggatgtgattaaatattcagacgtttagtgtatgattaagagtgagatagagatttctttggagtaattaaatccatcctgtcttttacacaatggacaaatcaagttaaaaaaatttttagatagcttagcttgttttctggtgctgttgacctgcaagagaatatacttttgcatatacaggtgaaagttttgcaatttatgtatacaagaaattgtaggcattaaaaatattttattgata

SEQ ID NO: 7309 - DNA, 6243 bp, Homo sapiens
gccgggcgtgggcgacggccggccgggggcgcacggagcagccgtcgcggggcctcgccgcggcctccagcgccccagtcacggggaatgcagtggtccccgacccctggcgcctctgcgtgtctgggctgggcttcctcgctcgcctgctccacggccccgacgctcctgggccgagccggccggggccccctcatggcggccaagtggttcaaggagttccccctgaacctgaagaccgtgtcggagcgggccaagcccgggggcggcggcggcaaattgcgcaagaactcggaggcgggcggcgctgggccgggtcctggcaagggccgcaagaactcggcggccgagctggggagcggcagggccggcgtcggccccaaggacagccggctgtcccgcgacagcctgcagggtctgattcaggccgccgcgggcaagggccgcaaaaactcccgggccacggaggaggagccccaccggggtgcaaccaagagctcgggctgcagcacctacatcaacaggctcatcaaggtggacactcaggagaagaacgggaagagcaactaccccagcagcagtagctccagctccagctcctcttcctccgcgtcctcttccccttcctccctggggcccgagctggacaagggcaagattattaagcagcaagagacggtcatcattttagaagactatgctgacccttatgatgccaaacggacaaagggtcaaagggatgcagagagagtcggagagaacgacggttacatggaaccatatgatgcacagcaaatgataacagaaattagacgacggggttccaaagatcccctggtgaaggctctccagctgcttgacagtccctgtgaacccgcagacggtggcctgaaatcagagaccttggccaaaagacggagttccaaggacctcctggggaagccgccacagctatacgacactccctacgagcctgcagaaggggggcccagggcagaggggaaggcgcggcccccagacagccggctgcccgagaacgacgagaggcccgcggcagagtacgagcagccatgggagtggaagaaggagcagatcgtgcgggctctgtcagtccagtttgaaggagctgagcgaccttccttcagggaggagacagtgaggcagcaccaccggcagaagagctggacccagaagatcctgaagccagccctctcggaccacagtgagggagagaaagtggacccgggcctgcccctggagaagcagccctggtatcatggtgccatcagccgtgctgaggctgagagtcgactacagccctgcaaagaagctggttacctggttcgaaatagtgagtcagggaacagcaggtactccattgccctaaagactagtcaaggatgtgtccacatcatagtggctcagaccaaagacaacaaatacacactgaatcagacaagcgctgtgtttgacagcatccctgaagtggtacactattattccaatgaaaagttgcctttcaaaggggcagaacacatgactttactctacccagtgcacagcaagcttcactaagattcagccactgcaagccctgggcctctggcaccttcaagggcatcatcagcgcacaaccagcatctcagaggacaaggctggactagcaactgctagaaaatgggagtcttccttgaaaagtcagagagtgatttgttttgttttgtttgagacgaagtctcgctgtgttgcccaggctggagtgcaatggcgcaatcttggctcactgcaacatctgactcctgggttcaagcagttcttccccatcagcctcccaagtaggtgggactataggttcgcaccaccactcccagctaatttttttttttgtatttttagtagagatggggtttcgccgtcttcgtcaggctggtctcaaactcctgacctcaaatgatccacccacctcagtctccccgagtgcctggattacaggcatgagccactgcacccggccaagtctttggtcttaaagtgattccatgacactttgtttgtggcctgtcccttgtttccttgctaagtagttctacaataagaaatcatgatttagctgttgcctccagctctggggtagggtgttctttttatggtgtgaccctcaggaaggttaagtcaggagttcaggagcatcagagttctctagaaatgtgcctacttgttacctggaatacctggtctctaaacaaaccaacaaaaaatccacgtggcttttccacatgatggtgcagactggaagaggatgttatattggactcgttattggggaaatgaatgagcgggagaaaatgtgaatgacgggcaagaaggtggtctttctccctcagaagtcctaattcagctctggagttcatggaaatccgcaacttcagagtgtggcctaaggattattttgttggtcagcctttccaagaaagtgtgtgttctctcaatctctgtggattttctcattttttagcaaatcagtgagataagcataaataggaaggaagataccccaggtttaagaatcaccaatatcattaggcattggcatcattattagaattctgaattatagaataaaaggtacaacaaaaatttcatttctgaattttaaaattctggaaatttgcaaagctccacaactgtttttttactgaattaattacatagaacttcgatgtcttttgtttcatcatcattgggcattttagttgctatggaataatttttaatttttgtctctaaaattagatttgctttgtagtaaattttttaaaaatgcaaccctaagatctgattatatgaactgggtctctaaagcctacaaagattctctcgttctgtaccaagcagactgccttgtactatacagaagtgtttgaaaagacctagaggttttctcttaaataccattacttaagattcatagtattaggatctttatgatttatcatgagcttatatcaccagtttatttactgtgaaaaaaaccatgggaatggcatactgtgagaagagtactatggtgaatggctccagaattaaaattcagcagatgtgtctgtattctggggttggtcatttgggtctcaaaactgccccatatgcaaatgtactgactgtcatcaatgaaaagttaacctttgtagcttataaatacacacaaaatgttgatttggttaattttttaggaaagtatacctttgtagttactagttacatttgactgtaagatttagaggttagtaaatttttgcttctttattcagataagatctcagccaaaaggttgtgtgatctttgattttaaaaatttaagaggaacttttcctcactggaacacaatgattttattaataaagaatgtaggctgggtgcggtggctcatgcacgtaatcccaacaatttgggaggctgaggcaggcagatcacgtgaggtcaggagtttgagaccagcctggccaacatggtgaaaccctgtctgtagtaaaaatacaaaaattagctgggcacggtggcgggcacctgtagttccagctgcttgggaggctgaggcacgagaatcacttgagcccaggaggtggaggttgcagtgagccaagattatgtcactgcactccatcctgggtgacaagagcgaaactccatctcaaaaaaaaaaaaaaaaaaaagcctggcctggtggtggatgcctgtggttccagctattcgggaggctgaggtaggtggatcacctctgctcaggtcaaggctgcagcgagccatgatcgcaccattgcactccagcctgagtgacagagtgagaccctgtctcaacaagcaagcaaacaaaaaaccaaaaggaatgtttttttcagatactgatagaatgttttcagtgtgtattggttcatttactatatctttagtgtaagattttaaaaggttttttcagcatccattcaacaaatatttattatctttatacaaattattcattgtgttaaacttatttttagtttaacattctagaaatgaaacgtttttacttaaccttattctacaaagggaatacagcagttattctaattttaataaatgctaaaagctttatacaatttttctttgtgcactaaatgatttttggcccatacccagcaactgtgatgaatgtataatgaaataacatcttgaaaacaggccagatacattaagtatttattgagcttctgtcatatgcccagtattatgcttcttctatactgtttctctgtgacaagtcatactatattctttatagaattaaaagtagaggagaggcagagtttacatattgtccagttgctttacagttgtacaggaggttataagaagaaatatagtaaattagtgggaagtcagaggtgggggcgttagtgagctattttcttcttgaggttgtgacacaagctgacaaaagccagggagttcacagctgtgtggtggcacaaagttccatatgttctaaaaacaattaggcccagcagggtgtccctaatggcttccttgttaaacctccatggccagctgatctgaagctctgtgacatgttctctgagctctgaatgctctggctttttgtcattttgtcttgagacaagtattttcctgtagtcctcattccttcgagttattccatctcccaggatattctctggtgagaagaatgtctttcagtgaatttgccttgaatttagcatccatagagctgtgtcagtgttcttcttgatcacaccttctttaaaaaaaatacttgcttgcgatgactggacaagttcagttggttagtttcaggcctataagaagagagagtaaaggaccttgctatttactttgataccatagttgtatctcaggatggcctgcaaaccactggccttgtgtgtatttaagctaggaataaaataatggagaagtgttaatatgtatacaaaaaggtaaatattgatatatctactctctgttgggggcagaagtgtcattttaagttattcaaagcactttcttaagcattttagaaagcctttattctttgctgttggaagtctccgtactttgcagaattggtatttgtgtactagcctctgccgcaggatggggaggtgggcaggtagctgataggggcagccaggagtttttgaggcaggtggtgggaaattgtcctaatttgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccccactaacgtggactagagaaacttggcctgctgtgcagtgggccttctgttcaacttaccctccaccgctgaccctgtgtgaagagagatggtgcgttactgccatctaatgggaaaagagaaaactgcagttgggaaaagcagctgtgcatttaagggtagggctttctgaaggatttctgatacagtccagaaaagggaaaatgatgacacagcagttgccatcttgaaaaatgccctttcctgcggaaagggtgttttgaagtctaatacaactatcatcacaaggtccctggactaaggctggatcgtgtaatttagaatctcaaattgtattttaattaatatgctggcaacagaatcattgaaacaggcgtctcattttgtcaagttcttagccgttcagtttgtcaggggctttaatattttagatatcaactaatacatagtttcaacttttaaaaatgtttgaagattgtatgtaatataggtgtctatctatagtgccttagtaatttaaatcagaaatattttataaaacttctggttgttttgcagtagccaatataggcttcatgccctcctgaagatagtttcctctgaaatgtaactttaaataaacattattccaagaaaa

SEQ ID NO: 7310 - DNA, 2500 bp, Homo sapiens
gtactaaccactatacgatcacggcgagctaccgggacgccacgacgagcagctgacccagtgttgcccttctcgtctagatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgagggtgtccacaatctccacagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagca

SEQ ID NO: 7311 - DNA, 2019 bp, Homo sapiens
atggtggcccaaagtctctctgacgctcaccatgccctgactatcatgctatctgaacgactttggctgggactggagctcttaaattttacaagaaggaaaatcagttctgacccaccaccatacaacttccttgaggcgcgagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagc

SEQ ID NO: 7312 - DNA, 2500 bp, Homo sapiens
gtactaaccactatacgatcacggcgagctaccgggacgccacgacgagcagctgacccagtgttgcccttctcgtctagatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgagggtgtccacaatctccacagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgtccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagcac

SEQ ID NO: 7313 - DNA, 1159 bp, Homo sapiens
cagtctggctggccccatgttactgagcggagctcctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctg

SEQ ID NO: 7314 - DNA, 2577 bp, Homo sapiens
caaaaggacagatgcagaggacaggcgccaggcacagataccatctcccttccccaagccagctgcccccaaccctccccctgcccgcaattagtcctctggggcgggagcggggcacagagcagagccctcttgggggaggggaagcccgatccgcacccacccttcctttgcccccctcttccttctgctgctccaatatcaatttcagccagtgacctctccaccaatttgcacatccccactctcccggtccgtttcaccgccagacatcggttccatttcgaccctcactggcggtcattcccaccccctctgctggtcaatttcaccccttttggcggtcaagtgcagtcccccatttcccgggcaatttccccctcccctccttctccctctcccctcccctccccagcagtgtcactcccagctgctccccacctcccgcgctccgcgctcgctgcggccagtctcgggcgtcccggtcagtgtccagctgccgcggcctcggccccggcgactcccgcccccagccccccttccctccgcgggcagcggctccctccctccccagaacagctgaaggtctcagtcacctccgaggggagcgcagggggaggggaggggcgggggacgcggcggaggggaggtgggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgcccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgtttg

SEQ ID NO: 7315 - DNA, 2576 bp, Homo sapiens
caaaaggacagatgcagaggacaggcgccaggcacagataccatctcccttccccaagccagctgcccccaaccctccccctgcccgcaattagtcctctggggcgggagcggggcacagagcagagccctcttgggggaggggaagcccgatccgcacccacccttcctttgcccccctcttccttctgctgctccaatatcaatttcagccagtgacctctccaccaatttgcacatccccactctcccggtccgtttcaccgccagacatcggttccatttcgaccctcactggcggtcattcccaccccctctgctggtcaatttcaccccttttggcggtcaagtgcagtcccccatttcccgggcaatttccccctcccctccttctccctctcccctcccctccccagcagtgtcactcccagctgctccccacctcccgcgctccgcgctcgctgcggccagtctcgggcgtcccggtcagtgtccagctgccgcggcctcggccccggcgactcccgcccccagccccccttccctccgcgggcagcggctccctccctccccagaacagctgaaggtctcagtcacctccgaggggagcgcagggggaggggaggggcgggggacgcggcggaggggaggtgggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgcccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgttt

SEQ ID NO: 7316 - DNA, 7050 bp, Homo sapiens
acactcgctctcgcacactcggtgacacgcccgcgcgcgcgctcacccacacgcccggccgccggcgccctcccagctggtccaccccggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgtttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgatttggctgtacagagaccccctgacttgggaggggaggggggagtggtgccccctcctccctccactccattactctctgcttgctacttcgcttgcccccagctcccaccctcagccctgtgactggaatgtgtgccccaccgtcattgtcctgagttgaatgtccctttgtgggggaggtggggggggcagtgtccatccacgaaggggcagaaggagggagccacgtgccccgccccacccgctcgggtgaagcccagtgggatttgcatctttctttctctttggttcctgcacatttatgggctgggaggcatccgtgtggaattgcgtgcagcctgtgtgtgtgctggcacaagcccatgcactgtgtgtgcagacgcatggggcctgcacccacaggcatggccgagcacatgtgtgggggaaggcgtgggcacataggtgcatgtaacctgtttgggcattggcacgtgcctacctgcatgttagcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagcccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctctcctgga

SEQ ID NO: 7317 - DNA, 3653 bp, Homo sapiens
gcattgcagcaaagggcaccggcggcggcggccgcggctgcggaggcggccgggggagagaagagcccgggcgggtgggagtaggggccctccctccccagccggacgcaggacctggggctggggaccccgcacgtacacctgtggccgcagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagaggtgtttgagagaagctcagtgtcttccctcccccccacgccccgccgccagctgatccccaccttgctgtccccccaggacctggggccccccgggggctcagccccaggccctacacggaagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggtctaatgagcaggcgcggaggctgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactc

SEQ ID NO: 7318 - DNA, 4632 bp, Homo sapiens
gttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggtctaatgagcaggcgcggaggctgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactcagaggcaagaggttagagatgggtgagtccatctctttttcagatgagggggcagctcagaggaggagaggggcttcccaaaggtgcacagcaaggtggcatcacagccaggatcgggacctaggaatcttggaacccttccctgcactggccctgggacagccctgggcacccaaggccctgcctccctactggctcccaggagaatttctcaaaaagcagccctccagccccccgcagcctctccacagctcccacctgcctcctcatggcccccagacaccctgcgagccccacctccagatctttttcctgccactgccagggatgagttccccttgtcctgtccgggctggaccctcctgggtgcccagcagagcagctgacactgacagagctttcgctggggccaggcatgcgcattatctcatctcacactcaccacactgaggaaggtctattacccccatgtgacgggggcggaaactgaggcttaatccaaggccacacggctagcaagtggggggcaggacacaagtccagactgcctccctccccaccacaaagtgcttcagcctctccagcagccccttccctcagctctaatgatgttgcactgtttcccaccctagtccctccctccccagagcccagctcctccgctgtggtgtcagcctcatgcctttatggcccagcctccaccccatctccggggttgcctgggtctccagtgacatcgagatgggctcttttcacccccctcccccactgctctgcagcatgtggccttgtagaccccccccacacctgcatagggctgtgcagaccctctgttcctcagcatcctctccccagcctccacctggagcctctgggctcctttctgggtgactccctctattttttgagacggagtcttgctctgtctcccaggctggagtccagtggtgtgatctcagctcactgcagcctccgcctcctgggttcaagtgattctcgtgcctcagcctcccgagcagctgagactacaggctaattaccacactggctaatttttgtatttttagtagagacggggtttcaccatgttggccaggctggtctcaaactcctgagctcaggtgatcctcccacctcagcctcccaaagtgctgggattacaggcgtgagccattgcaccctgcctgggcgactctcctttgcctgcctcttcccttcctgtgccccactcctcagcctcttctcctcacaccatgccttcctctcctcaggcaccaggtgcactgcttagtccctgcccccacccaggtctccattctgagctccagtcacccacacacgcttccccgggcatccccaggctcctcgaatgcgtgtgtccagacataatgctcccccgaccacgctgccccagccggtacgaggctgccccagctgctgtctccctcaggaagggtcgcccacccccagccttcccaagcccctccgtgcccctgtctcacttccagtgctccagtagcctttcttataaacatggcttctttcttgtaaagtaataaatgtttacagtgg

SEQ ID NO: 7319 - DNA, 1516 bp, Homo sapiens
ggctcccatggccctcgggcccagcgtggtgaccccgggggatggagccgttcctcaggaggcggctggccttcctgtccttcttctgggacaagatctggccggcgggcggcgagccggaccatggcacccccgggtccctggaccccaacactgacccagtgcccacgctccccgccgagccttgcagccccttccctcagctcttccttgcgctctatgacttcacggcgcggtgtggcggggagctgagtgtccgccgcggggacaggctctgtgccctcgaagaggggggcggctacatcttcgcacgcaggctttcgggccagcccagcgccgggctcgtgcccatcacccacgtggccaaggcttctcctgagacgctctcagaccaaccctggtactttagcggggtcagtcggacccaggcacagcagctgctcctctccccacccaacgaaccaggggccttcctcatccggcccagcgagagcagcctcgggggctactcactgtcagtccgggcccaggccaaggtctgccactaccgggtctccatggcagctgatggcagcctctacctgcagaagggacggctctttcccggcctggaggagctgctcacctactacaaggccaactggaagctgatccagaaccccctgctgcagccctgcatgccccagaaggccccgaggcaggacgtgtgggagcggccacactccgaattcgcccttgggaggaagctgggtgaaggctactttggggaggtgtgggaaggcctgtggctgggctccctgcccgtggcgatcaaggtcatcaagtcagccaacatgaagctcactgacctcgccaaggagatccagacactgaagggcctgcggcacgagcggctcatccggctgcacgcagtgtgctcgggcggggagcctgtgtacatcgtcacggaactcatgcgcaaggggaacctgcaggccttcctgggcacccccgagggccgggccctgcgtctgccgccactcctgggctttgcctgccaggtggctgagggcatgagctacctggaggagcagcgcgttgtgcaccgggacttggccgcccggaacgtgctcgtggacgacggcctggcctgcaaggtggctgacttcggcctggcccggctgctcaaggacgacatctactccccgagcagcagctccaagatcccggtcaagtggacagcgcctgaggcggccaattatcgtgtcttctcccagaagtcagacgtctggtccttcggcgtcctgctgcacgaggttttcacctatggccagtgtccctatgaagggatgaccaaccacgagacgctgcagcagatcatgcgagggtaccggctgccgcgcccggctgcctgcccggcggaggtctacgtgctcatgctggagtgctggaggagcagccccgaggaacggccctccttcgccacgctgcgggagaagctgcacgccatccacagatgccacccctgagtcctcac

SEQ ID NO: 7320 - DNA, 4509 bp, Homo sapiens
tggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggcatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagtttatagaaactcggggttacctaaagtagtctggataaattagaagaggctacctagagaaagtagtgactgaattgcaatttgattaaggataagaatgagggttatggcagttcctgacagagtgggtactgtgaacaaacaccagaggtagaacaagctgtgttatgtgtttgtcaagaattacaagcaatctggtgttgctggtgtatcataggcgaggcaggaagtggtaagaattgagactaccattttaagttcttaggaacaggaggaaggagtcgtgtgttccgtgtttgggagcttgaactgtaatgtgtaagcaatgagacaccattaaagagtttcaaggggggccgggcacagtggctcacgcctgtaatcccagcactttgggaggctgaggcgggcggatcacctgaggtcaggagttcaagaccagcctggccaacttggcgaaaccctgtctctactaaaaatagaaaaattagccggacgtggtgacaggcacctgtattcccagctactctggagtctggggcaggagaatcgctcaaacccaggaggtggaagttgcagtaagctgagatcacaccactgtactccagcctgggcgacagagcgagactctatctcaaaaaaaaaaaaaga

SEQ ID NO: 7321 - DNA, 1958 bp, Homo sapiens
aggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgcagaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactg

SEQ ID NO: 7322 - DNA, 1900 bp, Homo sapiens
ggccaaggctataaattcgcaggccgcggccgggccccacaggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaaca

SEQ ID NO: 7323 - DNA, 1634 bp, Homo sapiens
tgtagaacagctcacactggctggcactgctaagcaggtgcggaggggagtcagagacccccggatggaggggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaa

SEQ ID NO: 7324 - DNA, 6967 bp, Homo sapiens
cccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggaggtaaagtgactaatctgaacaaagcagagactccactgatgagaaaagcagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaagaaaagaaaaaaaaccccaaacttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 7325 - DNA, 6316 bp, Homo sapiens
gcagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaagaaaagaaaaaaaaccccaaacttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 7326 - DNA, 684 bp, Homo sapiens
gatgctgtcatcagggagcttgggggacaggcttcttggagtgtccccctggtgggacctggaatgtgttgaacttggctgagtggtgcaagggatcccctggtgccatccctgccaaagaccctatcagtgtcatgagcctgaggatgaaatctcccgatggatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacc

SEQ ID NO: 7327 - DNA, 6951 bp, Homo sapiens
cctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaagaaaagaaaaaaaaccccaaacttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctatttta

SEQ ID NO: 7328 - DNA, 2580 bp, Homo sapiens
accggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacac

SEQ ID NO: 7329 - DNA, 895 bp, Homo sapiens
ggaatgtgttgaacttggctgagtggtgcaagggatcccctggtgccatccctgccaaagaccctatcagtgtcatgagcctgaggatgaaatctcccgatggatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcc

SEQ ID NO: 7330 - DNA, 741 bp, Homo sapiens
ggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctcc

SEQ ID NO: 7331 - DNA, 4645 bp, Homo sapiens
gcatacggaggcgactcgcttccttcccgcccctccgccgcgctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 7332 - DNA, 577 bp, Homo sapiens
ataagccactccacaggagaaatgacttcattttttcaacaaatatatgccgtggaaaagaagaagtaagggagcgaggaactcttctagataagagagaattgaaaatggcacatcatccagtcatccaaacaaaatgtcctgtccttgtttggatccccttttgagcagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccg

SEQ ID NO: 7333 - DNA, 707 bp, Homo sapiens
gaggcgccacttgctggaagagggcgagagagacatttaaaaggcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctgga

SEQ ID NO: 7334 - DNA, 602 bp, Homo sapiens
gcttaatgctgatttaccaagcggagtgcaaattgtgtgatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaag

SEQ ID NO: 7335 - DNA, 504 bp, Homo sapiens
aacaaacccacgtgcgcacagccccggggaacacggatttctccacggcaccgcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaa

SEQ ID NO: 7336 - DNA, 608 bp, Homo sapiens
attattgactgagcagacagagagacgtgtcctcgccaacatctacaaatagctctgggctttggcaggcctggatgcaggatcttggaaaagaggagcgtgggtctgctgtttacagtgcaaagatttgacagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaaca

SEQ ID NO: 7337 - DNA, 568 bp, Homo sapiens
gaactttctgatagcttaataggaggaggttcctgtagggcggcacaaccagggagggcgtggaagctctgcatcccttctcccataccttgctctacacatctcttcatctgtatcctctgcagcatccttgatgataaaccagtaaattagagatggagtttcaccgtgttagccaagatggtcttgatctcctgtcctcatgatcctgatccgcctgcctcggcctcccaaagtgctgggattacagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattcc

SEQ ID NO: 7338 - DNA, 588 bp, Homo sapiens
aatgctgatttaccaagcggagtgcaaattgtgtgagatggagtttcaccgtgttagccaagatggtcttgatctcctgtcctcatgatcctgatccgcctgcctcggcctcccaaagtgctgggattacagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcct

SEQ ID NO: 7339 - DNA, 4302 bp, Homo sapiens
aactttctgatagcttaataggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 7340 - DNA, 1005 bp, Homo sapiens
actcagtccaggcctctatcatgcctggcacatagtgttgaatattgtattcaataaatattcaacagtaaatatttgttgaatacagtattaaatactatagaatttagacaggtccctgtatcaacaacagcaacaatgaccaccaccaccaccaccaccaccacaacaaaataacaagaatgtccaatgtagggggttgctttttgatccacttgcctttggctagtggtgtctttctctccttagcgccatattcttcagcacttttcggcagctgtatgtggttctattttggtctcctctttactgcacggcgattatgttttcaagaggcaaatcttcagggtgactagagtgacacgttatctgagttctggatggaggtaaaggaatatcacggtggtacttaagctccaagaacttacggcacacctgcttgagtggatcatgggtgagctggagaacctgaagtagcaaaggcaagaaggcaacgacgttccatctgtggaaggacctaccaaccagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaagg

SEQ ID NO: 7341 - DNA, 3947 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 7342 - DNA, 507 bp, Homo sapiens
cggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagttggctacatgtctgctatcttacccagaattcctagcctctatcatgaggcttgttttcctgctcagaacaaagtgacttccctgaacacatcttcattatgattcacaccaacctgaagaaaaagttcagctgctgcgtcctggtctttcttctgtttgcagtcatctgtgtgtg

SEQ ID NO: 7343 - DNA, 1963 bp, Homo sapiens
acgtgggggcgcctgagcgaagataaccgtaataaatagtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaaggcaaaatattattatagtcaggtgattgtagattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgctcctgcactttctcccctcccccacccggcacctggtggcaccgggccaggcccaggcgggtgctgcagcctggctggacagagccccaataaacgatcccacagcctc

SEQ ID NO: 7344 - DNA, 438 bp, Homo sapiens
tgctggtggacaagggccagagtgtggggctggagggagtcccggttcaagctcccaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacatt

SEQ ID NO: 7345 - DNA, 1100 bp, Homo sapiens
cacctccgcagcctggaaaatcccgagccgcggccgccgagcccccgagcccccgagcccccagcctagccgggaggggcgcgcggggctggggcccggggcggggccgggcggcgggacccactgctcctcccaccagagcccccgcgcggccccgggtctcccgggcagctgcggcggcggcgctggcaccccggccccggcgggccccggcggagcggcgggcaaaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgt

SEQ ID NO: 7346 - DNA, 558 bp, Homo sapiens
aaccgtaataaatagtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttggaccctgctgtgttgagatgagcaccagagccaagaagctgaggaggatctggagaattctggaggaagaggagagtgttgctggagctgtacagaccctgcttctcagaggaggaaagagaatcccagagaggccagaactcactgagagccccacggcgaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagg

SEQ ID NO: 7347 - DNA, 839 bp, Homo sapiens
gccttgttgccctgcacaacctgtgaatttgctccatcaaaactggcaggcagggttacccctgaggagggggtgggggagaaggggtaggggtgggaccctatcatctcccagaggggagatcaaggcagccatcatctgtcgaactagatggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggacccc

SEQ ID NO: 7348 - DNA, 1513 bp, Homo sapiens
aaccgtaataaatagtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttggaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgctcctgcactttctcccctcccccacccggcacctggtggcaccgggccaggcccaggcgggtgctgcagcctggctggacagagccccaataaacgatcccacagcctca

SEQ ID NO: 7349 - DNA, 620 bp, Homo sapiens
ggttgggtgtgtgtaggcttggtgtgcctctagcttggtgggggatgcaagctgtgggcatctctgagctgctgtggggctgtcatccctgcgagtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccc

SEQ ID NO: 7350 - DNA, 15584 bp, Homo sapiens
gggggcctgggatgctgccgctgagctgacccgctggacttgggttgtggcagacggatggcgaacgtgcaggtcgccgtgcgggtccggccgctcagcaagagggagaccaaagaagggggaagaattattgtggaagttgatggcaaagtggcaaaaatcaggaatttaaaggtggacaatcgaccagatggctttggggactcccgggagaaggttatggcatttggctttgattactgctactggtcagtcaacccagaggatccccagtatgcatctcaagatgtggttttccaggatttagggatggaagtactgtctggagttgccaaaggctataacatatgcctttttgcttatggacagacaggctctgggaagacatataccatgctggggaccccagcctctgttgggttgacaccacggatatgtgagggtctcttcgtcagggagaaagactgtgcctcactgccttcctcctgtaggataaaagtaagttttctagaaatctataatgaacgggtgcgggatctgttgaagcaatctggtcaaaaaaagtcctataccctgcgggtcagggagcatccagagatggggccctatgtacaaggtttatctcaacatgtagttaccaattataagcaagtaatccaactcttggaggagggaattgcaaacagaatcacagcagccacccatgttcatgaggccagcagcagatcccacgccattttcacgatccactacacgcaggcaatcctggagaacaacctcccttctgaaatggctagcaagatcaaccttgtggacctagcaggcagcgaaagagcagatcccagttactgtaaggaccgcattgctgaaggagccaatatcaacaagtcccttgtgactctaggaattgtcatctccaccttagcccagaactcccaagttttcagcagctgccagagcctcaacagctcagtcagcaatggtggtgacagtgggatccttagctctccttctgggaccagcagtggaggggcaccctcccgaaggcagtcttatatcccataccgagactctgtgttgacctggctgctgaaggacagccttggaggcaactctaaaaccatcatggttgccacggtgtctcctgcacacactagctacagtgagaccatgagcacactgagatatgcatccagtgccaaaaacattatcaacaagccacgagtaaatgaggatgcaaacttaaaactgattagagaactcagagaagagattgaaagactgaaagccctgctgctgagctttgaactgagaaacttcagttcattgagtgatgaaaacctgaaggagctggttctccaaaatgaattgaagatagaccagctgactaaagactggacccagaagtggaatgattggcaggccctcatggagcattacagtgtggacatcaacaggaggagggctggggtggtcatcgactccagcctgccacacttgatggccttggaggatgatgtgctcagcacaggtgttgtgctctatcatctcaaggaagggacaacaaaaataggaaggattgactcagaccaggaacaggacattgtcctgcagggtcagtggattgagagagaccactgcactatcaccagtgcctgtggtgtagttgttctacgacctgcccgtggggcccgctgtacagtcaatggccgggaggtcactgcctcctgccgtctgactcaaggagctgtcataaccctggggaaggcacagaagttccgattcaaccacccagcagaggctgctgtcctgcggcagcgaaggcaggttggagaggctgctgctggtcgtggctcgttggagtggctggatttggatggagatctcgctgcctcccggctgggtctctcccctttgctttggaaggaaaggagagcgcttgaagagcaatgtgacgaggaccatcagacaccgagggatggagagacatcccacagggcccagattcagcagcagcagagctacgtagaggatttgaggcatcaaatcctagcagaagagattcgagctgcgaaggaactggaatttgaccaagcttggattagccagcagattaaagaaaaccagcagtgtctgctcagagaagagacctggctggccagcttgcaacagcagcagcaagaagaccaggtagcagagaaagaacttgaggcatctgtggcacttgatgcttggcttcagacagatcctgagattcagccatccccatttgtccaaagtcagaaaagggtggtgcacctgcagctcctgcggagacacactcttcgggcagcagagcggaatgtccggcggaaaaaggtctcattccagctagagagaatcatcaaaaagcagaggctgctggaggcccagaagagactggagaagctcacgacattgtgctggctccaggatgacagcacccaggagcccccataccaggtcctcagccctgatgccacagtcccacggcctccatgtagaagcaaattgacgagttgcagttctttgagcccccaaagactctgcagcaagcacatgccccagctacacagcattttcctaagttgggatccctctaccacattgccacctaggcctgaccctacacaccaaacatcagagaaaacatcatcagaagagcatttgccacaggctgcttcctaccctgcaaggacagggtgcctccgcaagaacggcctgcattcctcaggtcatgggcagccctgcacagccagagcagccttggccaggaagggagcctcagctccagacgcttgcctcaccatgagtcccaactctgttggcatccaggaaatggagatgggggttaagcagccccatcagatggtgagccagggcttagcatctctgaggaaatcagctaacaaactaaagccaaggcatgagccaaagatcttcacctctactacccagaccagaggggcgaagggactagcagaccctagccacacacaagctgggtggcgaaaagaagggaaccttgggacccacaaggctgctaagggagccagttgcaattccttgtatcctcatggacccaggcagactgctgggcacggaaaggcagtcaagactttttggacagaatacaaaccaccttctccaagcagggcatcaaaaaggcatcagagggttctggcaactagggtcagaaatattaccaaaaagtcctctcacttgcctcttggcagtcctttgaagagacaacaaaatacaagggacccagacaccatggtcccactcacagatttcagcccagtaatggatcattcaagagaaaaagacaatgatttatctgacacagatagcaactactcattggattctctctcatgtgtctatgccaaagccctgatagagccactgaagccagaggagaggaaatgggatttcccagagccagagaactctgaaagtgatgacagccaactatctgaggactcactggctgagaagaggtaccaaagccccaaaaacaggctagggggcaatcgtcccaccaacaaccgtggccaacccaggaccagaactagagcttctgtgaggggcttcactgcagcctcagacagtgacctacttgctcaaactcataggagcttctccttggatagcctgattgatgcagaggaagaactgggggaagatcagcaagaagaacctttccctggttcagctgacgagatacccacagagactttttggcacctggaggactctagtctgcctgtaatggaccaagaggcaatatgcaggcttggtcccatcaactacagaacagcagctaggctggatgccgtcctgccaatgagcagttcgttttaccttgatcctcagttccaaccccattgtgagctccaaccccattgtgagctccaaccccattgtgagctccagccccattgtgagcaggctgaatcacaggtagagccaagctactctgaacaagccgactctctccaaggcatgcagctttcaagagagagcccactgatgtccatggattcctggttttcctgtgactctaagatcaaccccagcagccccccaggaatagtgggttctttatgtccaagtcctgatatgcaggaatttcactcctgtaagggggagaggcctggatactggccaaatactgaggaactaaagccatcagatgcagaaacggttctgccatatagctccaaactgcaccaaggcagtactgagctcctctgcagtgcaagagatgagcacacagcctctgctgctgatacgtctaggctgtctctctggggaattcaaaggcttattcaaccaggagctgatggcacctttcagggcagatgtatccctgacatgacccagcagggcagctctgaagcatcccacaattctagcgtatcaaacgtgctggctgcctctgccaccaccttgactcatgtaggcagcacccatgaaagggattggtctgcccttcagcagaagtacctccttgaactctcttgtcctgttttggaggccataggagcacccaagccagcttacccctaccttgaggaagactctggttccctggcccaagcttctagcaaaggaggagatactctattgccagttggccctagggtatctagcaatctgaatctcaacaactttccagtccatctgtccagaatcaggcgtttgagggcagagaaagaacaggacagtttaaatgccaaattagaaggtgtttcagatttctttagcactagtgagaaagaggcgagttatgacgaaacttattcggcagacttagaatcattgtctgcttctcgatctacaaatgcacaggtctttgcaacagagaacgcgataccagattccatgacagaagcatgtgaagtcaagcagaacaacttggaagaatgccttcagagttgcaggaaacctggactgatgacttcctctgatgaggattttttccagaagaacgcttgtcacagtaatgtcactacagccaccaaagcagaccattggtcccaaggctgggctcctctcaggaaaaatagtgcagtccagccagggcaattaagtcccgacagccactacccactagaggaagagaagacagattgccaggagagctctaaggaagcagttagaagacacataaatgtttcctttgcccttccttcaggtccagagctataccttcactctgctccctggaatccattgtcatcttccctgcagcccccactcttggaaacattctatgtgaccaaaagcagggatgccctgacagaaactgccttagagattccagcttgcagagaagtaagggtaccctccccaccccccagggaagcctggggctttggtcacaaccaccaagctctccaaggtgcttatttgaagaataatttgccagtgctgttacaaaaccagaattctaagattgcctcatctcagcaggtcacagctgagataccagttgatctgaataccagggaagtcatcagagaatcaggtaaatgccctggaaatattacagaagaaagccatgattcagtttattcttctgttactcagaacagacattttctcccctctaccagcacaaaagtatgtgaatttgaaaaccaagttgtaattttaaataaaaaacacagttttccagcacttgagggaggagaggtcactgctcagtcctgttgcggtgcttcctcagacagcactgagtctgggaagtctctcctctttcgtgaatctgaggcacgagaggaagaagagctggatcagaatacggttctgaggcagaccatcaatgtaagccttgagaaagacatgccaggggaaagtgctgtttctttgaaatccagatcagtagatcgtagagtaagcagcccagtgatggtggcccagggtggtggcccaacccctaagtgggaagggaaaaatgaaactgggcttcttgaaaaaggtcttcgtcccaaagatagctcagaagagtttaagcttccaggtacaaagcctgcatatgaaaggttccagttagttgcatgccctcaggaaagaaaccccagtgaatgcaagtcacaagaaatgttaaatcccaacagagaaccttctggaaagaaacagaataaaagagttaataatactgatgaaatggctaggctaattaggagtgtaatgcagctggaaaatggcatcttagaaattgaatctaagcagaataagcaggttcatgcttcccacacaccaggaaccgataaggagttggtgttccaggaccagaaggagcaggagaagactgaccatgcctttaggccagacagctctggaaaccctttgccctctaaggatcagccatcttctccaagacagacagatgatactgtctttagggatagtgaagctggagcgatggaggttaacagcattgggaaccatccccaggtccagaaaatcaccccaaaccccttcaggtcaagggaaggtgtacgagagagtgaacctgtgagagagcacacccacccagctggatcggacagacctgccagggatatttgtgattctttagggaaacacacaacttgcagagagttcaccaacacttctcttcacccacagagaatgaaagcattggctagagctctgccattgcaacccaggctagagaggtcttctaagaataatggccagtttgtaaaagcatcagcaagtctcaaagggcagccttggggcttaggaagtcttgaggaattggagactgtgaaaggttttcaggaaagccaagtagctgaacacgtaagtagttccaaccaagaagagccaaaagctcaaggtaaagttgaagaaatgcctatgcaaaggggaggcagccttcaggaagaaaataaagtgactcagaaatttcctagtctcagccagctttgtagggacacgtttttcaggcaggaaactgtcagcccattactaagccggacagaattctgtacagctcctcttcaccaagacctgagtaataccttgcccttgaattctccaaggtggccaagaaggtgtcttcatgtacctgttgctctaggcatctcttcacttgactgtgtgctggatctcacaatgttgaaaattcataacagtcccttggtaactggagtagagcatcaggaccagagtacggagaccagaagccacagccccgaaggaaatgttagagggcgttcctctgaggcacacactgcctggtgtgggtctgtgcgatccatggccatgggatctcatagtcaatctggtgtaccagagagcattcctctggggacagaggacaggatctcagcaagcaccagcccccaagaccatggaaaggacctcagaatcaccttgctgggtttcagtaccagtgaagattttgcttctgaagccgaggtggctgtacaaaaagaaataagagtcagttcactgaacaaggtctctagccagcctgaaaagagggtcagcttctccttggaagaggatagtgaccaagccagcaagccaaggcagaaggcagagaaggagactgaggacgtcggactgaccagcggtgtttccttagcacctgtttccctgccgagggtgcccagtccagagcctaggctgttggagccctctgaccatgcatccatgtgcctggccatcttggaggagatcagacaggcaaaggcccagagaaagcagcttcatgactttgtggccaggggcacagtcctttcttactgtgaaactttactagaacccgaatgttcttcaagggttgctggcaggcctcagtgtaaacaaatagaccagtcatcatcagaccagaccaggaatgagggtgaagcaccgggatttcatgtggcatctctatctgctgaagcagggcagatagatctgttacctgatgagaggaaagtccaggccacatctctgtctgcagacagctttgaatctctgcccaatacggaaactgacagagagccatgggatcctgtgcaggctttctcccatgctgctcctgctcaagacaggaaacgtcgtactggagaactgaggcagttcgcgggagcaagtgaaccatttatatgtcactctagttcttctgaaatcatagagaaaaagaaagatgcaaccagaacaccttcctcagctgatcctttggccccagacagtcctcgttcttcagcacctgtggaggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaaggtagggcaagtcccaaacaagataccattctgcctggagctctgacaagggttgcactggaagctcccacacagcagtgtgtgcagtgtaaggagagtgttgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcaatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgttctgaatctacctcctctagcattcagctctactgtgtgatgggacgttaaaaataccaaaacagaaagagggtttaaaaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaagtcctctgtgtacttta

SEQ ID NO: 7351 - DNA, 1250 bp, Homo sapiens
agggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattga

SEQ ID NO: 7352 - DNA, 2288 bp, Homo sapiens
gaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaagtgtccagttctttatttcccaaatgtgtcctttgggtaattgttaaaaagttctcgaaacctggctttcatccatctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttggaggctgggaagtccaatatcaaggtgccagcagattcagtgtctggtgagggcttgccatctgcttcaaagatgatgcctttttgctgcatcctcacatggcagaagggaagggcaaaagggcttccttgagccttttctttaaggcactaatcccattcatgaaggtggagtcctcatgatctcacctcttaaggccctatctcttaattctgtagtgtcgggattaggattcaacctgtatattgggggagacagcaacattcacaccatagcagaagtcctccatgctttgggggtttgagattctaggtagattagaaaatacgagcaaggaaataaagtgtttgctagtagaaggcaaaggaggcatccagacccagcagtcttggtctccaggacactgaaccatggctggaaaagaagctctcctcctcccttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 7353 - DNA, 1159 bp, Homo sapiens
aaaactgaggaggcggagccaagacggtcggggctgcttgctaactccaggaacaggtttaagtttttgaaactgaagtaggcctacacagtaggaactcatgtcatttcttgtaagtaaaccagagcgaatcaggaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtg

SEQ ID NO: 7354 - DNA, 4053 bp, Homo sapiens
atggtcctgacgctgcttctctccgcctacaagctgtgtcgcttcttcgccatgtcgggcccacggcggggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagtgggtcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgctttcgctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaaaggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccagggga

SEQ ID NO: 7355 - DNA, 6977 bp, Homo sapiens
ccaaaacccgggtctctccgcgtggccccgcctccaggccggggatgtcccccgcggccccgcgcccatggtcctgacgctgcttctctccgcctacaagctgtgtcgcttcttcgccatgtcgggcccacggcggggcgccgagcggctggcggtgcctgggccagatgggggcggtggcacgggcccatggtgggctgcgggtggcccgggcccgcgagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagtgggtcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgctttcgctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaaaggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcgttttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataacttttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggatagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagaatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcac

SEQ ID NO: 7356 - DNA, 4425 bp, Homo sapiens
cgcacacgcacacacacacggagcatcctcccgtcaggtctcctggtccagccccgcccgcgcctcctgcttccagcgaacctgttccctctccccacatcccccgccctccatctcccccggctctgggacccttcccgccgacctcacccccacccccgggatggagcggctcgagcccgcccggagccccccgcggccggggtgacggtccccccacccctctcctgcccggcccccgcctcgagcaccatgggcctgaggggttcccggggcgccagacgctgaagatgaccgatgccggagctctcttgagtcatggcttcttcaaagctccgagaacccgtggatgaagtttttgacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaatttctgtctgctccagttgttgggttggccggactctgctgggccctgagtatggtgggacaacaggtctgtcaccaggtgctgggccatccggcgttctgaacagatggctttgcccagtgttttactcacagtcctgagctgggccggacgtccccggtgcgtcatgtggtggtcacagggcaccgcagtgtgcgtgtgtacgtgcgcacgtgtgggtcccctcccccagggatgcagccaggccagtctcattcagtctcctctttactgtgggtgtgggtgtcactgtcactgccacagccactgggagggacacacagctttaacccctgtgtgcttaggggaagggtgggggcattcagggttataaaactaactatatacacagaaggtcctagggagaaagccaccctgagcacacatgtctgggcacagtgggggctgggggctggagctcaggcaggatggactaggcttgtggaggagcgggtgggcatgagcatgtgaggacatgctgggagggctcaggaggtggcacagacattgccaaggccactgcagggcctcgagcagcttggctggatggcaagctctcggtctaacaaggttcttccactttagagttgggccctgtgagagccaccccctccgccaccgaccttcaagccctgagcggagggagaggctgcaggaccagcctcattccccactcacgggtgtaactcctttccccactcagtccccaggtctggagggcacccaccctcttcctaacacttcagcaggccaaggccagggtgcctttgtgggctgggggaataaggcaacgggacatccacttggaaggcctgtgctgtggagggtgctgagggggacccagtacccctggcagaaaagtgacagccctggtctcagagaggaggactgccatgggaaaatgtctctgggacaccccatcagggtggagacatccctaaccctcaggcatcgcccacagagatagggaggccaccgaggggtctccacagagatggactggcacttagggaccatcacagacctatcaccgcagtgacttccatagagacagaacctggtcatcagggagaacccaccccctgctcccccaggaggatggtgaggggcaccacggtggggggacccagaggcggcagtccgtcctctcaggtgcagatgcacggcggcccttagctgacgcggtacgtggacgtgttcttgggctccgtgctgggcacacaccagtcg

SEQ ID NO: 7357 - DNA, 1938 bp, Homo sapiens
ggcgctcgctcttcgctcttctctctctctctctctctgtcacacacacacacacgcacacgcacacgcacacacacacggagcatcctcccgtcaggtctcctggtccagccccgcccgcgcctcctgcttccagcgaacctgttccctctccccacatcccccgccctccatctcccccggctctgggacccttcccgccgacctcacccccacccccgggatggagcggctcgagcccgcccggagccccccgcggccggggtgacggtccccccacccctctcctgcccggcccccgcctcgagcaccatgggcctgaggggttcccggggcgccagacgctgaagatgaccgatgccggagctctcttgagtcatggcttcttcaaagctccgagaacccgtggatgaagtttttgacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggcccagctcctggctcatgcacaggaggcactgagcaactcctggtgcctagtccaggacttcggctccacccagatagggatggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgagga

SEQ ID NO: 7358 - DNA, 560 bp, Homo sapiens
gcttccagcgaacctgttccctctccccacatcccccgccctccatctcccccggctctgggacccttcccgccgacctcacccccacccccgggatggagcggctcgagcccgcccggagccccccgcggccggggtgacggtccccccacccctctcctgcccggcccccgcctcgagcaccatgggcctgaggggttcccggggcgccagacgctgaagatgaccgatgccggagatttgattggacagttgatgattgaaagcttttaggggatgctaatgatgcgaaggcccaagacagtgaaggggagaagttcagtgacccacgtgaaggcacacagcaaatcagtggaccaggataccaggaccacagggctcagcctgtgtctgtgccttggttttgcgtctgcccccaccctcctactatactgcctgccccggcgcccaccatctgggttatgattccagtggcttctcttccaggggacagaagaagggttctaagctctcttgagtcatggcttcttcaaagctccgagaacccgtggatgaagttt

SEQ ID NO: 7359 - DNA, 2564 bp, Homo sapiens
acagccgagcgcagcctgcaggccggaagaagcggcgcggcggccgcttgaaaagctagctgacccaggggcggccacaggagctctggcccgctgaggctggcgatgaggccgcagggagggttactgcgtgcttgtgacagacgatttttaaagtcagggcttgaaagaacaaacaaaacctggggaagagtcaggaagacactgccggaaatcgtggtatccatagagacgctatcggaagttggggttgctaggaagccgcggcgcgtctgctaagctgcaaatggctgaagtcccggaggattatgattccggcccagatgaagatggagagctggagcctgagaggcctgaactgcctggacttcataaattgtatgaaaatgccgaaccagacaccatggcaaaggcagactcgaagctaccagcagagatttaccaagagccacagccagagaccgaggaagaggacttcaaagagggggagccagacagtgctaagaacgtgcagctgaaacctggcgggacgtcccaggaaggaattgccaaggagtccaagagagacgtaccaagcgaaactgaaccagggatacaccaagaggtaaagtcggaaacatccagagagatgggagagtttttcaaagatttggaggcccctatggatgaaacgcataaagagtcagacctagagccaccagaggaggctaaaccaaatgttacagaggatgtgttcctagagtcagctatggaaacagatccagatccagtgccaccaacggaaaccatgtctgaggtttcgggggccacagtcagagagagaaatttagaattactagaggaggagactgaaccgggggttccagaggaatcacttagagtgcaacatgaagagacaggtctagagcctccagagcagaccaaacaagattttccaagtgagaaactaggagaatcacttgaagagacagatcttcagccaccaaagatgaccaaaccagagactccagaggagacacaaagagagtcaactgagaagaaaaggacagagccacccgagcaggctagactggaatttctggagaaggaaccaagaaagtctagtgaggaggcaggtctagagcctccagaagagactcaaccagaggttccagaggagatgcaaagaaaggcaactgaggagaaagggacagaactacctgagcggactaaaccagactttccagaccacaagccaagaaagtctactgatgagaacgttcctgagccactagaagagatcaaattagagtttcctgaggaagaatcaagaaaaacaaatgaggaaacaattctagaacaatcagaaatgatgaaaccagaaagtccagaagagataagaaagtcaaatgagaaaaaaaatccacagccaccagaggagactggtccagtgctaccacaggagatcaacccacaagttgaagagaaaacacaaacaaagccaactgagaaaattctagagttaccagatgaaaccaaaccaagggagacacatgtagaattttccaaggaagacaggccagaaccaataaagtctaagtattctgtaggaaacgatgagctagagcaccgtgagcctaaaagaggaaagttgtcactaagtgacaaatttagaaaagaatattacgcattaggatctctcagagaaagtgaagaatcaattggtacacattatgagtttttgcaaccactccaaaaattgcttaatgtcagtgaagaatgctcatactcagatccctcagagtctcagacagaattaagtgagttcgttcatgaaaaggaagttgtagatttgtcccaagagttgaaggaacgggtctctgaagatgacgaaacccagccagaaaaagggactgagttacaatttgagcatcttaattgggatccagaggaagttgcagagtggattagccagctaggcttccctcaatacaaggagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcttgaaagatcaaactaaattacttgagggaagaggtatggtcttttttggttttctttttctccttttttttttttttatttttttgagacagagtcttgctctgtcgcccaggctggagtgcaatggcacagtctcagctcactgcaaccttgcgattctcctgtctcagcctcccgagtagctgggattacaggcatccgccatcatgcccagctaatttttgtattttt

SEQ ID NO: 7360 - DNA, 993 bp, Homo sapiens
atttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttcgctggagtatagtggcgcgatctcagctcactgcaacctccgcctcctgggttcaagcaattctctggggcagcagttctaagctctggttgcacattaggattcctagagattcagattgaattaatttgaggatgggattattctaatgtacaaccacggctgagaaccactgccgctgacgtttcaacacaaagtttgctgtttgaacctgcctgtctcctggatttcaaagaccactgtcttcattgcacaacaatgtgaatataatcaacactattgaactgtacctaagaatagttaataaaaaactgagtgttta

SEQ ID NO: 7361 - DNA, 2377 bp, Homo sapiens
aaaagacgcggccaaggcccgctcggtccacgcttcccgccggcccggcaaggggttccggagaacggcttgggggggcgagaaccatgggcgggggaaatggaagacagagggaactgaagcacgggggtcttcgatgagcagtgcggatgttcgactccaaacatcaaagccaacgagaggttcaggttactcctccttgaccccaaacatccagtgagtggagactggcctgttcacagagtaaaatatgtcgtctctaattcggcaaagacggtgatgactgtatatatgcaggccaattccgctctccaagagattctaactcagtcacagtttgaaccactactgaaccactgctgttaggaagctacaacccaaaagaaaagccccacagatgctgagagctggtgatcctcaggataaaacaaaggaaccagaaccacatccactgatcggatttgcctggggaggaggggtgctctctcctttgatcttctcttctggaagagatggaccaaaagcctctccagcaataatccgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcattaaa

SEQ ID NO: 7362 - DNA, 2028 bp, Homo sapiens
ataaaacaaaggaaccagaaccacatccactgatcggatttgcctggggaggaggggtgctctctcctttgatcttctcttctggaagagatggaccaaaagcctctccagcaataatccgtccacttacatgcagattttcttctgcctctgccacccctgagacagcaagaccaactctcctcttcctcctcctcctcctcagcctactcactgcaagacgacgagtatgaagatctttatgatgatccacttccatgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgct

SEQ ID NO: 7363 - DNA, 2093 bp, Homo sapiens
cccagtcttgctgtctttcaatggggcagccactgctcagttgctgccattcagaaatatgaacccagtatcaccagaacttttgatttttcaagagaaaccaagattccagatttgtaggtgatatcttccatttttcagataaaacaaaggaaccagaaccacatccactgatcggatttgcctggggaggaggggtgctctctcctttgatcttctcttctggaagagatggaccaaaagcctctccagcaataatccgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcatt

SEQ ID NO: 7364 - DNA, 592 bp, Homo sapiens
aagaatagtattggaaggaaggacagaaacattcagattctccagagaaatgtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataagga

SEQ ID NO: 7365 - DNA, 4488 bp, Homo sapiens
ggtcggtgcgggaggagggaggggagcttgcgggcccgagagggggcgacggcggcggcggtggcctgaggaggcccgagcggcggcggtggcggcgaaggccgaggcgtctaggtgtttttggaagagctgcagcctttgaagaaacatctcttgatgatgatatcatagactccttcctactgggcagatgaggcagaatggggcacagtagttccagcaaaaatccagagaggactatccttggccaggctttaccccatgtccacttctggagccaagaaagacagttccttctccaaggggaacccagggtgttgatactagaagatggaaatggatacagtaagatgctgccacagtgagatgcctcacccaggtctccctctgtcacttcagccaagcacatgggatagaaagtagcaggcggcctctggccctttaatggaagagggccatccagtcctctccagttaacatctagaccgaacacaaagcatccttctctcatccagaagacataggaaccctaccttcagggatgatttttttttaacagtgaaatcttaaaagtaactgtttcactaaagcctccagtatttactgaagactgtcagaatcatcctccatcactagatcttctccaccagtcatgttccctgagcagtggggtggcttgaaggtataaaccagagaggcccaagggagggatagttagcagacttctggtctttttctagtttgtgctcttctgttccaaggaccacaggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggg

SEQ ID NO: 7366 - DNA, 4486 bp, Homo sapiens
ggtcggtgcgggaggagggaggggagcttgcgggcccgagagggggcgacggcggcggcggtggcctgaggaggcccgagcggcggcggtggcggcgaaggccgaggcgtctaggtgtttttggaagagctgcagcctttgaagaaacatctcttgatgatgatatcatagactccttcctactgggcagatgaggcagaatggggcacagtagttccagcaaaaatccagagaggactatccttggccaggctttaccccatgtccacttctggagccaagaaagacagttccttctccaaggggaacccagggtgttgatactagaagatggaaatggatacagtaagatgctgccacagtgagatgcctcacccaggtctccctctgtcacttcagccaagcacatgggatagaaagtagcaggcggcctctggccctttaatggaagagggccatccagtcctctccagttaacatctagaccgaacacaaagcatccttctctcatccagaagacataggaaccctaccttcagggatgatttttttttaacagtgaaatcttaaaagtaactgtttcactaaagcctccagtatttactgaagactgtcagaatcatcctccatcactagatcttctccaccagtcatgttccctgagcagtggggtggcttgaaggtataaaccagagaggcccaagggagggatagttagcagacttctggtctttttctagtttgtgctcttctgttccaaggaccacaggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggg

SEQ ID NO: 7367 - DNA, 6089 bp, Homo sapiens
ccatgtgcaccaacatagtttacgagtggctcaaagcgctgcagcttccgcagtacgcggagtccttcgtggataacggctacgatgacctggaggtgtgcaagcagatcggggacccggacctggatgccatcggggtgctggcgcccgcgcaccgccgccgtatcctggaggccgtgcgccggctgcgggagcaggacgccaacgccgccggcctctacttcacgcttgagccgcagccggcgccccccgggccgcccgccgacgccgtccccaccggccgccggggggagccgtgcggcggcccggcccagggcacccgcggggactctcgcggccacacgaccgccccccgcagcagggagctggtgagctaccccaaactgaagctgaagatcatgatcagggataagctcgtccgtgacggcatccacctgagcaagcccccgtactcccgcaaggtcccaatggctggcatcctagagtacttaatgaattggccgaagtcatcacagagccgctagatatcatttttgagacctcgtggaggactgatgaggtgcctgaagactggaaaagggcatatttagaaccttctttcaaaaagggaaatggatgatgaccctggaaatactcatcagcttaactttttgcttggacaaattctggaataatcaacttagtaaactgggtaactggcttataacagctagaaataaggcagtgaactatcacgcataaagaagtattgagttcatttttttaagaagatatcatgatgagatacagtcttatgcatttcttggcattctcccttccattcttaatgaaaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttggctcacagtgactttcgcctcccaggttcaaggaattctcctgcctcggcctcttggtagctgggattacaggcacgcatcaccacacccagctaatttttttgtatttttagtagagatggggttttaccatgttggccaggctgttcttgaactcctggcctcaaatgatccactcgccgtggcctccagtagcgctgggattacaggcgtgagccatcacacccggcctggatgctggtagttttattttctgcttagaaaacgcaaccatgttgatgggaccaaaaacttagttgaaagaagccatggcaaaagatgttgacgtacaactggctcctgaggctgtcaattgtttagagctcccaagtagtactgcattacggaatctactacttagaagaatgtacaagatgtaagttcccatcggcaccgtcatggtaagaagaataagaaactctcaaaggaaaagaaacttacattcactttttcctggtccattttggttcctaagaatagataggccattaagaaggatattaggtttctaaggacaattttaacacaatactgctttaaaaatctgaagtttaaatagtttagctatttctgtaggttaattcaggcactgactaaaatcagtctcattatcatatacaaatgtaaggaagttaaattttaaaagcatgtataggttgtccttaaattatacaaaagcttttagtttcatcaggattatattccagttaacctttcatcttttttttttttccaaatgaactagggtctttaaaattcctaagtagattcttttgagtggtaggggagtctgtatagattacagatataatttattgtgataacaaatggcttcctgtttgacctcatttccaggtgtcgcatccgtggctgatttatttcacagatgtacatttgcatgtacttgttgaactttgctaggaaggactcaatttttgaaaaatctgttattttcactgtgggccttatgaggcaatctactgcaatggaaaaagggttccttggtcatttcaagttttattttctattagagtaatatctaacttcaattattttgccaggtttaaaccttctctctgtgtctgtggttagaatttgaaaataacaatgctctgcttaaagtaagagtcacagtcagcaaaaaaagccaatggattttaaaaagacatcttagttaaagctagaggaagaaaacttcaaataagcaaagaagtattgaaggatgcccacgaattcctttgcattaaaatcaagatgaggtaagaggtagaatataagagaaagggattatttttaccatgaattgtatctggggacagttagtcttagaaggagtaattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctcaaaacaaaacaaaacaaaacaaaacagcaaattcataaaggccagcagttttcaagtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcagatcatttgaggtcaggagtttgagaccagcctggccaacatggtgaaaccctgtgtctactaaaaatacaaaaaaaattagctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcg

SEQ ID NO: 7368 - DNA, 2376 bp, Homo sapiens
gggcttaacatcttttagcctatctgtagaggatatcagagggcaaagtttctgtcatgaaataggactaatcaacttagttgaatttgtatttaaagcaaggttaaactgaattaagaccatttttgaaagaattgtcagatgtacctttcaacccgcagccagagaagcttctgcagttgaaggccagaaagtctttgtatggttcttccatctgcaatatcaaagacaagaagtcttcatagaggatggcctcctttggggattccaaagtaagacaatctcatctccttttggtgattcatctccacggcttttcctaaagaactccattagtggcgagagatattgaagacaaacccggtgatggctgtgaaccctttattgacaccaacagggcagcagacaatcccactgatcccctcaccatttgggcctccaactgtggacagagatgtattgccttccaccgtagctccaactgacccaagacagttttgcgttccttcccaatttggatcctctgttctaccaaacacaaatatggcaaatgtgttgtccagtcggatctacccaggttggggcattttaccacctgaatccataaaggcagtggccagaaggaatgaaatgattcaacggcatcatactgccaggacagaaatggaaatgtatgctatttaccagcaaaggagaatggaaaaaattaatcccaagggactagcaggcctagggatacccttcctctatggctccagtgtcccagctgcccccgctgcctaccatggcaggagcatgctccctgccggtgacctgcattttcacagaagcaccctcagaaaccttcagggaaaccccatgctagcggcaactgcaccacactttgaggagagctgggggcagagatgtcgtcgactcaggaaaaatacagggaatcaaaaagctctagacagtgatgctgagagttccaaaagtcaagcagaagaaaaaatcctaggtcagactcatgcagttccctatgaagaggatcattatgcaaaagacccagacattgaagcacccagcaaccagaagtcaagtgaaacgaatgaaaagccaacgacagctcttgccaacacctgtggagagctcgagcccacccataggaaaccctgggggtctcacaccactaccctgaaagcaaaggcctgggacgatgggaaagaggaggcttcggagcagatttttgcaacctgtgatgaaaagaatggggtttgccctccagttcctcgaccatctctgccaggaacacatgcactggttacaattggggggaatctttctttggatgaagatattcagaagtggaccgtggatgatgtgcacagcttcattcgcagccttccaggttgttcagactatgctcaggtatttaaagatcatgcaattgatggagaaactttgccattactcacagaagagcatcttcgaggcactatgggattaaagctagggccggcactaaaaattcagtcacaggtatctcagcatgtgggaagtatgttctacaagaaaactctttcatttcctataagacaagcatttgatcaaccagcagatacatcccctcttctggatcctaattcctggagtgatacaatgaacattttttgtccccaggatacaataattcctaaaggaattgagcgaggtagtatgagaaactaaaagccctcaaggaggaagaatagtcttagccagttttccaaagagcctaggatattacaaaggatgtgtgaggatttcccagtactggatggagaatgagaagagaaagtcagcctttctggggctttcatggaggagacttgcccaaggggcttccctgccagggctgaatgaccccagcaccaaatgactggagacgcatccttaggagcaaatgctaatgaaggggagatttacaaacatcaagaaagctgcagatggatgtttccatgaagaaatctctgaagaaaccaaaagagctgaaactgaaaaaagagctccctcccttttttcactcattttccattcccaaaccctgaaagagataaaggcaacccaatgaaaccacagagaggcagaagagaacgggcagaagtacagaacagaaatggagaagctgaccacgactccatctcttctcattccagatttccagcgtgaagcaggcccaagctagggaaggtgagaagctttaaccttaaattttcgagttttggccaggcgcggtggctcacggctgtaatcccaacactttgggagtctgaggcgggcggatcatgaggtcaggagattaagaccagcttggccaacatggtgaaaccccgtctctactaaaaatacaaaaaaaaa

SEQ ID NO: 7369 - DNA, 2399 bp, Homo sapiens
gggcttaacatcttttagcctatctgtagaggatatcagagggcaaagtttctgtcatgaaataggactaatcaacttagttgaatttgtatttaaagcaaggttaaactgaattaagaccatttttgaaagaattgtcagatgtacctttcaacccgcagccagagaagcttctgcagttgaaggccagaaagtctttgtatggttcttccatctgcaatatcaaagacaagaagtcttcatagaggatggcctcctttggggattccaaagtaagacaatctcatctccttttggtgattcatctccacggcttttcctaaaggtaacatgtaagaggaagaggtgaactccattagtggcgagagatattgaagacaaacccggtgatggctgtgaaccctttattgacaccaacagggcagcagacaatcccactgatcccctcaccatttgggcctccaactgtggacagagatgtattgccttccaccgtagctccaactgacccaagacagttttgcgttccttcccaatttggatcctctgttctaccaaacacaaatatggcaaatgtgttgtccagtcggatctacccaggttggggcattttaccacctgaatccataaaggcagtggccagaaggaatgaaatgattcaacggcatcatactgccaggacagaaatggaaatgtatgctatttaccagcaaaggagaatggaaaaaattaatcccaagggactagcaggcctagggatacccttcctctatggctccagtgtcccagctgcccccgctgcctaccatggcaggagcatgctccctgccggtgacctgcattttcacagaagcaccctcagaaaccttcagggaaaccccatgctagcggcaactgcaccacactttgaggagagctgggggcagagatgtcgtcgactcaggaaaaatacagggaatcaaaaagctctagacagtgatgctgagagttccaaaagtcaagcagaagaaaaaatcctaggtcagactcatgcagttccctatgaagaggatcattatgcaaaagacccagacattgaagcacccagcaaccagaagtcaagtgaaacgaatgaaaagccaacgacagctcttgccaacacctgtggagagctcgagcccacccataggaaaccctgggggtctcacaccactaccctgaaagcaaaggcctgggacgatgggaaagaggaggcttcggagcagatttttgcaacctgtgatgaaaagaatggggtttgccctccagttcctcgaccatctctgccaggaacacatgcactggttacaattggggggaatctttctttggatgaagatattcagaagtggaccgtggatgatgtgcacagcttcattcgcagccttccaggttgttcagactatgctcaggtatttaaagatcatgcaattgatggagaaactttgccattactcacagaagagcatcttcgaggcactatgggattaaagctagggccggcactaaaaattcagtcacaggtatctcagcatgtgggaagtatgttctacaagaaaactctttcatttcctataagacaagcatttgatcaaccagcagatacatcccctcttctggatcctaattcctggagtgatacaatgaacattttttgtccccaggatacaataattcctaaaggaattgagcgaggtagtatgagaaactaaaagccctcaaggaggaagaatagtcttagccagttttccaaagagcctaggatattacaaaggatgtgtgaggatttcccagtactggatggagaatgagaagagaaagtcagcctttctggggctttcatggaggagacttgcccaaggggcttccctgccagggctgaatgaccccagcaccaaatgactggagacgcatccttaggagcaaatgctaatgaaggggagatttacaaacatcaagaaagctgcagatggatgtttccatgaagaaatctctgaagaaaccaaaagagctgaaactgaaaaaagagctccctcccttttttcactcattttccattcccaaaccctgaaagagataaaggcaacccaatgaaaccacagagaggcagaagagaacgggcagaagtacagaacagaaatggagaagctgaccacgactccatctcttctcattccagatttccagcgtgaagcaggcccaagctagggaaggtgagaagctttaaccttaaattttcgagttttggccaggcgcggtggctcacggctgtaatcccaacactttgggagtctgaggcgggcggatcatgaggtcaggagattaagaccagcttggccaacatggtgaaaccccgtctctactaaaaatacaaaaaaaaa

SEQ ID NO: 7370 - DNA, 4673 bp, Homo sapiens
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaa

SEQ ID NO: 7371 - DNA, 4027 bp, Homo sapiens
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggaattga

SEQ ID NO: 7372 - DNA, 4716 bp, Homo sapiens
atgtcccagctgcagctgtggctgcagtttgaggctctgaacaagggcatggcaccaggctcaccccagacccgagctgctcagagttcctgcagcattgctgcccttcaggtgctgcagaagtcagacgccgtcctgcgtggccctgaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataaggtcagtgcgcccggtgcccccagccagccccgacccaccagcgtggcctccccagcccgggacccacacggtccagtgaggctgcgagggcccaccagctgtgacctgtcccgtctggcccgggctgacatcctgctccccttccagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaaggtaggggctgtgctcggcaaagtagggggcaaggtggggaccgtgccctgcaaaatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaaccgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctgggtgagcacaggtgccggggtgtggtgtgggtggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaat

SEQ ID NO: 7373 - DNA, 4924 bp, Homo sapiens
gtgcgcggggcccccaagatggcgcccgaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttccc

SEQ ID NO: 7374 - DNA, 4592 bp, Homo sapiens
gacatgcaaatgcagccgggcggagagccgcccccgtccgccccggccgacccaatgctggggctgctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttccc

SEQ ID NO: 7375 - DNA, 2143 bp, Homo sapiens
tgctttttttttttttcccgaacgaccgcagcagggtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattagtagcttgctctaaacttacaaatgttttagagaattctttggcatgatctgactttccaactaaaatgtgagcaacttga

SEQ ID NO: 7376 - DNA, 855 bp, Homo sapiens
tccgcccccagtcgtagcctcggacggtttctgagcgttggtgtttggcacgcgccaccctctcttgctttggttccgccatgccgatgtaccagtctttggtagatgagtggctggatagctacaagcaagaccaggatgcaggatttctggagcttgttaactttttcatctgatcttgtggatgtaaaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccct

SEQ ID NO: 7377 - DNA, 1429 bp, Homo sapiens
ggaacttgcctcatgtgtgtgtatgtgtgtgtgtgtgattgtgggtgtgggtagtttaacctttttatatcttagctgcctgtaaactcagtgattgctacgttcagatcaaaccttgaacttttttttttctggtgccaggagccttcctgtgctccccattgcctgccagaaccaccaccgtttcccatggttactctacagcagcttcactgcctgaaaatgaaaactgaacaaagggattaaattgtgagaacaactgtcaatctattatatatttgtacaatctggtattaaaatgctttccccaaaagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcaggtatagaacaattggagaagaatccatcaccccggattgtgaaaacacatctaccgactgatcttcttcctaaatctttctgggaaaacaattgcaagatgatttatctggctcgtaatgccaaggatgtttcagtctcatattaccattttgacttaatgaataatttacagccttttcctggtacctgggaagaatatctggagaaattcttaactggaaaagtggcctatggttcctggtttactcatgttaaaaactggtggaagaaaaaggaagaacacccaatactttttttgtactatgaagatatgaaagagaatccaaaggaggaaatcaagaagatcattagatttctagagaagaacctgaatgatgagatcttggataggatcatccatcacacctcatttgaagtgatgaaggacaatcctttggtaaattatacacatctaccaactacagtgatggatcatagcaaatccccttttatgcgtaaagggacggctggtgactggaagaattacttcaccgtggcccaaaatgagaaatttgatgctatttatgagacagaaatgtccaaaactgcacttcaattccgcacagagatttaaagtgtctaaatcacacatctgaagaaataagagattgtctgtagttgattgaaacgagggcagttatgaattgatttgggcaatcaaatgaatttataaaggagaataatatgcttttaatatgttgattcttttcaatgttattaatcagatcccagttttgttcctttgattctgagtttccaaattctctaaggctaaagttcattgttaactttttgtaacaaaggaacaatgtaa

SEQ ID NO: 7378 - DNA, 694 bp, Homo sapiens
cttgaacttttttttttctggtgccaggagccttcctgtgctccccattgcctgccagaaccaccaccgtttcccatggttactctacagcagcttcactgcctgaaaatgaaaactgaacaaagggattaaattgtgagtggaactgaagcatgcaaggaatggaggtcttctcaagaaactaacaactgtcaatctattatatatttgtacaatctggtattaaaatgctttccccaaaagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcaggtatagaacaattggagaagaatccatcaccccggattgtgaaaacacatctaccgactgatcttcttcctaaatctttctgggaaaacaattgcaagatgatttatctggctcgtaatgccaaggatgtttcagtctcatattaccattttgacttaatgaataatttacagccttttcctggtacctg

SEQ ID NO: 7379 - DNA, 1556 bp, Homo sapiens
cttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtgga

SEQ ID NO: 7380 - DNA, 1680 bp, Homo sapiens
acttactccaacagcagtcaagagaatgaacaggagggcatgacaagaggcagaagacagaaggcaagaagaccactcagcattacagaagcccaacaaacagatattttcagttaaaataagatagaggcaacaaaaagtaataaggaatgacctgaaatatcatgagggaaaatgtacaaggcagtgacagactggatgttggcagtgaagtacagagtgaagcggagggcaattcccaggttcctgaaggtttcatgaggaaagagtggtgccattaatcaagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca

SEQ ID NO: 7381 - DNA, 1681 bp, Homo sapiens
caccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcagtggaaatggatcgtcataaaggtcttcatcctcatcatcatgttgagtaggctgaagaggaggaggaaaaggagcaattggtcttgctgtctcaggggtggcagaggcaaaagaaaatccatgtctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca
